US011913051B2

(12) United States Patent
Faridmoayer et al.

(10) Patent No.: US 11,913,051 B2
(45) Date of Patent: Feb. 27, 2024

(54) ENGINEERED AND FULLY-FUNCTIONAL CUSTOMIZED GLYCOPROTEINS

(71) Applicant: LimmaTech Biologics AG, Schlieren (CH)

(72) Inventors: Amirreza Faridmoayer, Zurich (CH); Manuela Mally, Watt (CH); Rainer Follador, Zurich (CH)

(73) Assignee: LimmaTech Biologics AG, Schlieren (CH)

( * ) Notice: Subject to any disclaimer, the term of this patent is extended or adjusted under 35 U.S.C. 154(b) by 122 days.

(21) Appl. No.: 16/625,579

(22) PCT Filed: Jun. 28, 2018

(86) PCT No.: PCT/EP2018/067494

§ 371 (c)(1),
(2) Date: Dec. 20, 2019

(87) PCT Pub. No.: WO2019/002512

PCT Pub. Date: Jan. 3, 2019

(65) Prior Publication Data

US 2021/0332403 A1 Oct. 28, 2021

Related U.S. Application Data

(60) Provisional application No. 62/527,466, filed on Jun. 30, 2017.

(51) Int. Cl.

| | |
|---|---|
| ***C12P 21/00*** | (2006.01) |
| ***C12N 1/10*** | (2006.01) |
| ***C12N 9/10*** | (2006.01) |
| ***C12R 1/90*** | (2006.01) |

(52) U.S. Cl.

CPC ............ *C12P 21/005* (2013.01); *C12N 1/105* (2021.05); *C12N 9/1029* (2013.01); *C12N 9/1051* (2013.01); *C12N 9/1081* (2013.01); *C07K 2319/04* (2013.01); *C07K 2319/05* (2013.01); *C12R 2001/90* (2021.05); *C12Y 203/01003* (2013.01); *C12Y 204/01022* (2013.01); *C12Y 204/01101* (2013.01); *C12Y 204/01143* (2013.01); *C12Y 204/99006* (2013.01)

(58) Field of Classification Search

CPC ..... C12P 21/005; C12N 1/105; C12N 9/1029; C12N 9/1051; C12N 9/1081; C07K 2319/04; C07K 2319/05; C07K 2317/14; C07K 14/44; C12R 2001/90; C12Y 203/01003; C12Y 204/01022; C12Y 204/01101; C12Y 204/01143; C12Y 204/99006

See application file for complete search history.

(56) References Cited

U.S. PATENT DOCUMENTS

| | | | |
|---|---|---|---|
| 11,236,136 B2 | 2/2022 | Wetter et al. | |
| 2006/0286637 A1 | 12/2006 | Hamilton | |
| 2018/0354997 A1 | 12/2018 | Wetter et al. | |
| 2022/0242919 A1 | 8/2022 | Wetter et al. | |
| 2023/0048847 A1 | 2/2023 | Mally et al. | |

FOREIGN PATENT DOCUMENTS

| | | | |
|---|---|---|---|
| CA | 2388151 C * | 1/2010 | ............ C12N 15/85 |
| WO | WO 2007/130638 | 11/2007 | |
| WO | WO 2017/093291 | 6/2017 | |
| WO | WO 2019/002512 | 1/2019 | |
| WO | WO 2021/140143 | 7/2021 | |
| WO | WO 2021/140144 | 7/2021 | |
| WO | WO 2022/053673 | 3/2022 | |

OTHER PUBLICATIONS

Späth et al. Lipophosphoglycan is a virulence factor distinct from related glycoconjugates in the protozoan parasite Leishmania major. PNAS (2000), 97(6), 9258-9263. (Year: 2000).*

Carrilo et al. Heterologous Expression of Trypanosoma cruzi trans-Sialidase in Leishmania major Enhances Virulence. Infection and Immunity (2000), 68(5), 2728-2734. (Year: 2000).*

Grabenhorst et al. The Cytoplasmic, Transmembrane, and Stem Regions of Glycosyltransferases Specify Their in Vivo Functional Sublocalization and Stability in the Golgi. JBC (1999), 274(51), 36107-36116. (Year: 1999).*

Raymond et al. 2012. Genome sequencing of the lizard parasite Leishmania tarentolae reveals loss of genes associated to the intracellular stage of human pathogenic species. Nucleic Acids Research (2012), 40(3), 1131-1147. (Year: 2012).*

Sansom et al. Golgi-Located NTPDase1 of Leishmania major Is Required for Lipophosphoglycan Elongation and Normal Lesion Development whereas Secreted NTPDase2 Is Dispensable for Virulence. PLoS Negl Trop Dis (2014), 8(12), e3402, 12 pages. (Year: 2014).*

Kasajima et al. In Vivo Expression of UDP-N-Acetylglucosamine: (alpha)-3-D-Mannoside (alpha)-1,2-N Acetylglucosaminyltransferase I (GnT-1) in Aspergillus oryzae and Effects on the Sugar Chain of (alpha)-Amylase. Biosci Biotechnol Biochem (2006), 70(11), 2662-2668. (Year: 2006).*

Hu et al. Remarkable Structural Similarities between Diverse Glycosyltransferases. Chemistry and Biology (2002), 9, 1287-1296. (Year: 2002).*

Almeida et al. Cloning and Expression of a Proteoglycan UDP-Galactose:(beta)-Xylose (beta)1,4-Galactosyltransferase I. JBC (1998), 274(37), 26165-26171. (Year: 1998).*

Breitung et al, 2002, "Non-pathogenic trypanosomatid protozoa as a platform for protein research and production," Protein Expr. Purif., 25(2):209-218.

(Continued)

*Primary Examiner* — Sean C. Barron

(74) *Attorney, Agent, or Firm* — Jones Day

(57) ABSTRACT

Described herein are compositions and methods of producing glycosylated proteins in vitro and in vivo. The methods include using host cells to produce glycosylated proteins. Also described herein are glycosylated proteins produced using such methods and uses thereof.

49 Claims, 69 Drawing Sheets

Figure 1:
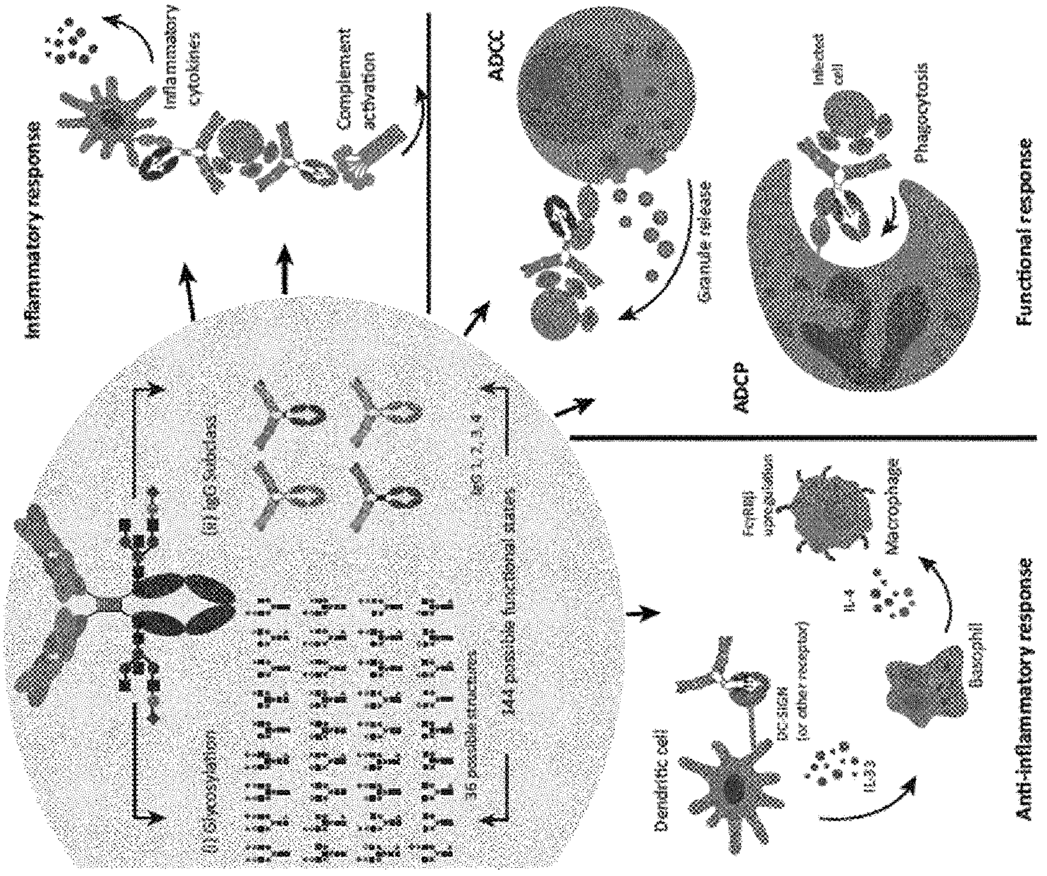

Specification includes a Sequence Listing.

(56) References Cited

OTHER PUBLICATIONS

Cox et al, 2006, "Glycan optimization of a human monoclonal antibody in the aquatic plant Lemna minor," Nat. Biotechnol., 24(12):1591-1597.
Czlapinski et al, 2006, "Synthetic glycohiology: Exploits in the Golgi compartment," Curr. Opin. Chem, Biol., 10 (6):645-651.
Basile et al., 2009, "Recombinant protein expression in Leishmania tarentolae," Mol. Biotechnol., 43(3):273-276.
Montestino et al, 2012, "Structural characterization of N-linked oligosaccharides on monoclonal antibody Nirnotuzumab through process development," Biologicals, 40(4):288-298.
Choi et al, 2012, "Improvement of N-glycan site occupancy of therapeutic glycoproteins produced in Pichia pastoris," Appl. Microbiol. Biotechnol., 95(3):671-682.
Geisler et al, 2015, "Engineering β1,4-galactosyltransferase I to reduce secretion and enhance N-glycan elongation in insect cells," J. Biotechnol., 193:52-65 (Epub 2014).
Kurogochi et al, 2015, "Glycoengineered Monoclonal Antibodies with Homogeneous Glycan (M3, G0, G2, and A2) Using a Chemoenzymatic Approach Have Different Affinities for FcγRIIIa and Variable Antibody-Dependent Cellular Cytotoxicity Activities," PLoS One, 10(7):e0132848 (24 pages).
Khan et al, 2017, "Humanizing glycosylation pathways in eukaryotic expression systems," World J. Microbiol. Biotechnol., 33(1):4, 12 pages (Epub 2016).
International Search Report and Written Opinion dated Jan. 30, 2019 for PCT/EP2018/067494 (22 pages).

* cited by examiner open
fucose “clash”
low binding closed
no binding
binding to DC SIGN open
high affinity binding
engineered glycans/ no fucose
+/- sialic acid:
*moving between open and closed Synthesis Trimming Final N-glycan

| Fragment | Type | theoretical mass [M+Na]+ | measured mass [M+Na]+ |
|---|---|---|---|
| Y-HexNAc1 | Y | 300,1 | 300,7 |
| Y-Hex2-B | BY | 431,2 | 431,0 |
| Y-Hex2-B | BY | 431,2 | |
| Y-HexNAc2 | Y | 545,3 | 545,8 |
| Y-Hex2HexNAc1-B | BY | 676,3 | 676,3 |
| Z-Hex2HexNAc1-C | CZ | 676,3 | |
| Hex3HexNAc1-B | B | 894,4 | 894,4 |
| Y-Hex2HexNAc2 | Y | 953,5 | 953,9 |
| Y-Hex2HexNAc2 | Y | 953,5 | |

| Fragment | Type | theoretical mass [M+Na]+ | measured mass [M+Na]+ |
|---|---|---|---|
| Y-Hex3HexNAc1-B | BY | 880,4 | 882,3 |
| Z-Hex3HexNAc1-C | CZ | 880,4 | |
| Y-Hex2HexNAc2 | Y | 953,5 | 953,8 |
| Y-Hex2HexNAc2-^{1,4}A | ^{1,4}A_{GlcNAc}Y | 1080,5 | 1080,5 |
| Hex3HexNAc2-C | C | 1157,6 | 1158,2 |
| Y-Hex3HexNAc2 | Y | 1157,6 | |

| Fragment | Type | theoretical mass [M+Na]+ | measured mass [M+Na]+ |
|---|---|---|---|
| Y–HexNAc1–B | BY | 268,1 | 268,1 |
| Z–HexNAc1–C | CZ | 268,1 | |
| ^{1,5}X–HexNAc2 | ^{1,5}X_{Man} | 573,3 | 571,8 |
| Y–Hex1HexNAc1–^{1,5}A | ^{1,5}A_{Man}Y | 648,3 | 648,3 |
| Y–Hex1HexNAc1–^{1,5}A | ^{1,5}A_{Man}Y | 648,3 | |
| Z–Hex2HexNAc2–^{3,5}A | ^{3,5}A_{GlcNAc}Z | 991,5 | 991,5 |
| Z–Hex2HexNAc2–^{3,5}A | ^{3,5}A_{GlcNAc}Z | 991,5 | |
| Hex3HexNAc2–C | C | 1157,6 | 1156,7 |
| Y–Hex2HexNAc3 | Y | 1198,6 | 1198,7 |
| Y–Hex2HexNAc3 | Y | 1198,6 | |
| Y–Hex3HexNAc3 | Y | 1402,7 | 1403,7 |
| Y–Hex3HexNAc3 | Y | 1402,7 | |
| Hex3HexNAc4 | | 1661,8 | 1661,8 |

St11521

```
        10         20         30         40         50         60
APPRLICDSR VLERYLLEAK EAENITTGCA EHCSLNENIT VPDTKVNFYA WKRMEVGQQA

        70         80         90        100        110        120
VEVWQGLALL SEAVLRGQAL LVNSSQPWEP LQLHVDKAVS GLRSLTTLLR ALGAQKEAIS

       130        140        150        160        170
PPDAASAAPL RTITADTFRK LFRVYSNFLR GKLKLYTGEA CRTGDAGAWS HPQFEK
```

Coverage 116 out of 176 amino acids: 66%

St11895

```
        10         20         30         40         50         60
APPRLICDSR VLERYLLEAK EAENITTGCA EHCSLNENIT VPDTKVNFYA WKRMEVGQQA

        70         80         90        100        110        120
VEVWQGLALL SEAVLRGQAL LVNSSQPWEP LQLHVDKAVS GLRSLTTLLR ALGAQKEAIS

       130        140        150        160        170
PPDAASAAPL RTITADTFRK LFRVYSNFLR GKLKLYTGEA CRTGDAGAWS HPQFEK
```

Coverage 122 out of 176 amino acids: 69%

FIG. 19

St11521

| theoretical glycopeptide mass | measured glycopeptide mass | Ion Type | glycan structures | peptide mass [M] | peptide sequence N24 and N38 |
|---|---|---|---|---|---|
| 4425.833 | 4425,956 | [M+H]+ | $(Man)_2$ $(GlcNAc)_2$ and $(Man)_3(GlcNAc)_2$ | 2802.244 | EAENITTGCAEHCSLNENITVPDTK |
| 4587.885 | 4588,062 | [M+H]+ | 2 x $(Man)_3$ $(GlcNAc)_2$ | 2802.244 | EAENITTGCAEHCSLNENITVPDTK |
| 4609.867 | 4610,025 | [M+Na]+ | 2 x $(Man)_3$ $(GlcNAc)_2$ | 2802.244 | EAENITTGCAEHCSLNENITVPDTK |
| 4625.841 | 4627,040 | [M+K]+ | 2 x $(Man)_3$ $(GlcNAc)_2$ | 2802.244 | EAENITTGCAEHCSLNENITVPDTK |

St11895

| theoretical glycopeptide mass | measured glycopeptide mass | Ion Type | glycan structures | peptide mass [M] | peptide sequence N24 and N38 |
|---|---|---|---|---|---|
| 4587.885 | 4588,101 | [M+H]+ | 2x $(Man)_3(GlcNAc)_2$ | 2802.244 | EAENITTGCAEHCSLNENITVPDTK |
| 4609.867 | 4610,079 | [M+Na]+ | 2x $(Man)_3(GlcNAc)_2$ | 2802.244 | EAENITTGCAEHCSLNENITVPDTK |
| 4625.841 | 4627,100 | [M+K]+ | 2x $(Man)_3(GlcNAc)_2$ | 2802.244 | EAENITTGCAEHCSLNENITVPDTK |
| 4790.965 | 4791,23 | [M+H]+ | $(GlcNAc)_1(Man)_3(GlcNAc)_2$ and $(Man)_3(GlcNAc)_2$ | 2802.244 | EAENITTGCAEHCSLNENITVPDTK |
| 4812.947 | 4812,161 | [M+Na]+ | $(GlcNAc)_1(Man)_3(GlcNAc)_2$ and $(Man)_3(GlcNAc)_2$ | 2802.244 | EAENITTGCAEHCSLNENITVPDTK |
| 4828.921 | 4829,167 | [M+K]+ | $(GlcNAc)_1(Man)_3(GlcNAc)_2$ and $(Man)_3(GlcNAc)_2$ | 2802.244 | EAENITTGCAEHCSLNENITVPDTK |
| 4994.044 | 4994,304 | [M+H]+ | 2x $(GlcNAc)_1(Man)_3(GlcNAc)_2$ | 2802.244 | EAENITTGCAEHCSLNENITVPDTK |
| 5016.026 | 5016,240 | [M+Na]+ | 2x $(GlcNAc)_1(Man)_3(GlcNAc)_2$ | 2802.244 | EAENITTGCAEHCSLNENITVPDTK |

FIG. 20

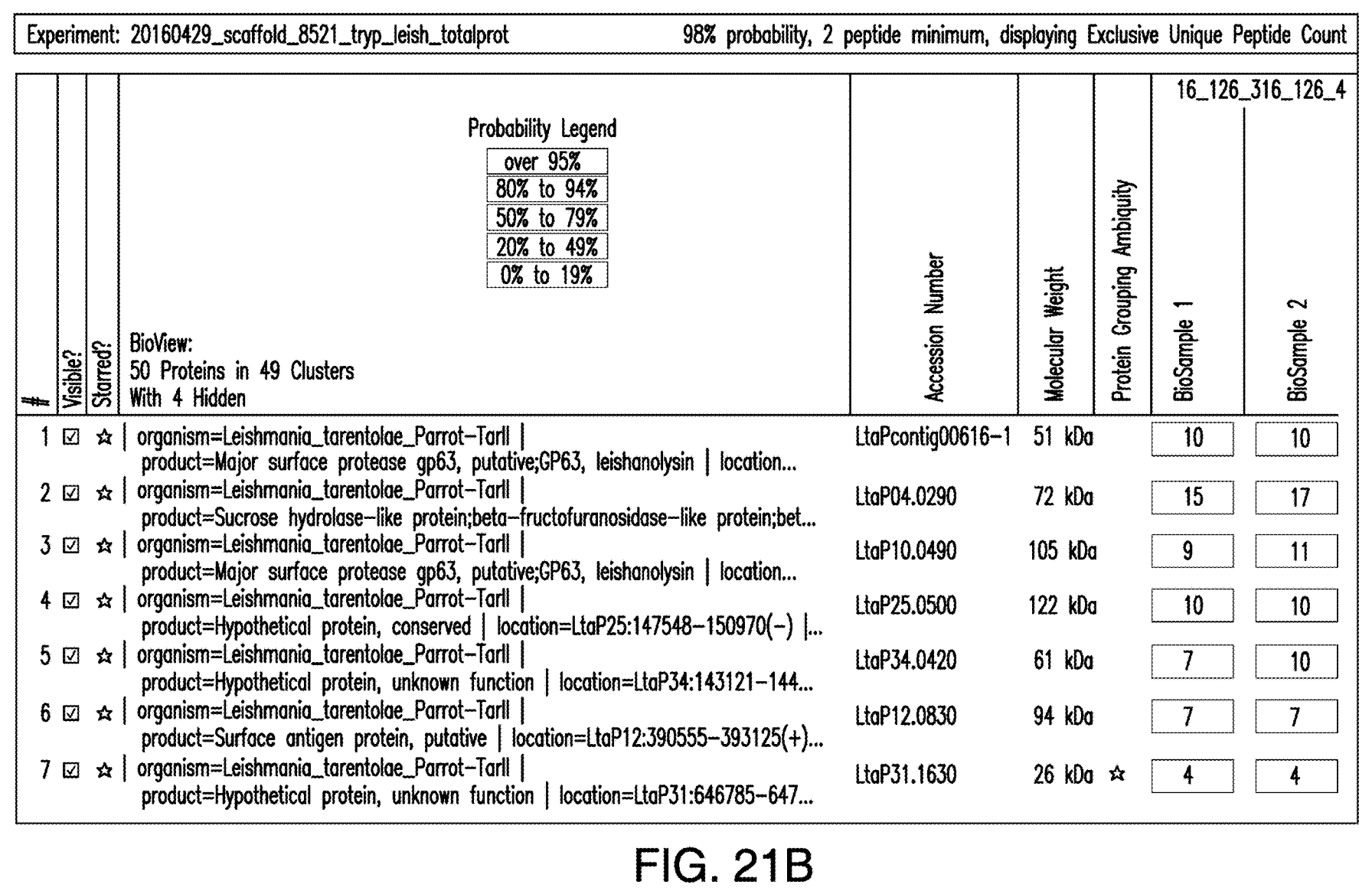

Experiment: 20160429_scaffold_8521_tryp_leish_totalprot     98% probability, 2 peptide minimum, displaying Exclusive Unique Peptide Count Probability Legend
- over 95%
- 80% to 94%
- 50% to 79%
- 20% to 49%
- 0% to 19%

| # | Visible? | Starred? | BioView: 50 Proteins in 49 Clusters With 4 Hidden | Accession Number | Molecular Weight | Protein Grouping Ambiguity | 16_126_316_126_4 BioSample 1 | BioSample 2 |
|---|---|---|---|---|---|---|---|---|
| 1 | ☑ | ☆ | organism=Leishmania_tarentolae_Parrot-TarII \| product=Major surface protease gp63, putative;GP63, leishanolysin \| location... | LtaPcontig00616-1 | 51 kDa | | 10 | 10 |
| 2 | ☑ | ☆ | organism=Leishmania_tarentolae_Parrot-TarII \| product=Sucrose hydrolase-like protein;beta-fructofuranosidase-like protein;bet... | LtaP04.0290 | 72 kDa | | 15 | 17 |
| 3 | ☑ | ☆ | organism=Leishmania_tarentolae_Parrot-TarII \| product=Major surface protease gp63, putative;GP63, leishanolysin \| location... | LtaP10.0490 | 105 kDa | | 9 | 11 |
| 4 | ☑ | ☆ | organism=Leishmania_tarentolae_Parrot-TarII \| product=Hypothetical protein, conserved \| location=LtaP25:147548-150970(-) \|... | LtaP25.0500 | 122 kDa | | 10 | 10 |
| 5 | ☑ | ☆ | organism=Leishmania_tarentolae_Parrot-TarII \| product=Hypothetical protein, unknown function \| location=LtaP34:143121-144... | LtaP34.0420 | 61 kDa | | 7 | 10 |
| 6 | ☑ | ☆ | organism=Leishmania_tarentolae_Parrot-TarII \| product=Surface antigen protein, putative \| location=LtaP12:390555-393125(+)... | LtaP12.0830 | 94 kDa | | 7 | 7 |
| 7 | ☑ | ☆ | organism=Leishmania_tarentolae_Parrot-TarII \| product=Hypothetical protein, unknown function \| location=LtaP31:646785-647... | LtaP31.1630 | 26 kDa | ☆ | 4 | 4 |

FIG. 21B

LtaP04.0290 (100%), 71513.8 Da
|organism=Leishmania_tarentoise_Parrot-Tarll|product=Sucrose hydroiase-like protein;beta-fructofuranosidase-like protein;beta-fructosidase-like protein;beta-fructofuranosidase, putative|location=LtaP04;90092-92002(*)
16 exclusive unique peptides, 22 exclusive unique spectra, 34 total spectra, 180,636 amino acids (28 % coverage)

MIASSVRHAV ILLLVAVAMM AAAVIAKDGV PYEPIYHIRP PKNWINDPNG PYRDPVTGKI HLYMQYNPNG PLWGDIAWYH
VTSEDYVKWT RPESPVAVWA DKWYDRWGAY SGTMMNNNLK EPVMVYTCTE PENIQRQCIA NPPKSDLKGK RTLNTLVKSP
LNVIMSEDMI PGIVAMENFR DPTEWWQDPA NPNRWLIAFV ARIKDDEGDN AHVIVFSTED PSFQSGYSFS HSLYVYKYDL
SHMFECPDFF TLKQGGEHYL KVSTMPSHRQ YIIYGSYELN TTSRQYVFVE DPERSFTFID YGPFYASKTF HDPILNRRTI
WGWTNDELSD EQIIANGWSG VQNMLRTMVY DATEKKIKTH PVPEIKGLRV DKLIDVRDIA VTETPKLVIA NSTLYHEIVA
RFTLADPATF SATATYASDS DVPEVGVMIR VNANLSQYTT VSVRMPSGGP NASPNTEQTE TYPAIKVFDS TSAANCSAEC
NKMRLCESYT WKSDTCNLYW KINPMVSAAD ATSGTVREPL LYLGRTKSGT IGSTAPLHGR APFAVATPNG FELHIFVDDS
VVEVFKDDGL ETLTGRLYID NSADTTGIAY YARNAGDVTA NIEVYTMDSI WAPPKRSAVK NFTDSLYNLL DTLVDA

FIG. 22B

| Lane | 1 | 2 | 3 | 4 | 5 | 6 | 7 | 8 | 9 |
|---|---|---|---|---|---|---|---|---|---|
| Strain | St11376 ssu::rhEPO-Strep (LMSAP) | | | | St11377 ssu::rhEPO-Strep (Spinv) | | | | Loading control |
| Sample | #1 | #2 | #3 | #4 | #2 | #3 | #4 | #5 | |

N- 1 CTS MAN1 (LtaP09. 1430 or <<LTAR_090021500. 1>>); cis -C

MQRQRIRHHLRFVDRYIVLAVLGVVVYILVVSLIAESLAIGVRDR

N- 1 CTS LtaNTPDase1 (LtaP15. 0020, <<LTAR_150005200. 1>>); unknown -C

MRPNLSVRRMTHQWKRLRVTGTLVLSALVLFAFVVYYQSPSFSPCDS

N- 1 CTS LtaNTPDase2 (LtaP10. 0140, <<LTAR_100006700. 1>>); unknown -C

MAASTCERGWLQRFACASPIRNTLSRIFSAPMEARATGGRLRGSTRRAVAVFFTAVFAVVFLTVYEVGIGVANPHQSLHT

N- 1 CTS GRIP (LtaP11. 0070, <<LTAR_110005600. 1>>); TGN -C presumed Golgi proteins >GRIP C-term
KRASTQAERVPQLEQETNELRTRCDLLRKELQRQREAMQPERSQLYETARSE
ATASSATENVGAVQSALLAAAGCVSERDVVTFVGHRSLQDGSVKLSKAAAEQ
LRKENTELKRENAHNNTVIAQYIRELEGYKANERVQLSIEYLRNIVHQYLCA
AEDLRPKMIPAICTVLEFSSKQKEDVQAANVRCPQFH

FIG. 24B

| | SN purif. (120 OD) | | | | | Pellet purif. (60 OD) | | | | Localization (60 OD) | | | | | |
|---|---|---|---|---|---|---|---|---|---|---|---|---|---|---|---|
| Slot | 1 | 2 | 3 | 4 | 5 | 6 | 7 | 8 | M | 9 | 10 | 11 | 12 | 13 | 14 |
| Sample | WCE 1OD | SN TCA 10OD | FT SN TCA 10OD | Wash SN TCA total | SN HA-ELU 1/3 15µL | FT-pellet | Wash pellet TCA Total | Pellet HA-Elu 1/3 15µL | | TritonX+ Lysate (OD60) 1/20 20µL | TritonX+ Insol. fr (OD60) 1/20 20µL | TritonX+ Debris (OD60) 1/20 20µL | TritonX- Lysate (OD60) 1/20 20µL | TritonX- Insol. fr (OD60) 1/20 20µL | TritonX- Debris (OD60) 1/20 20µL |

| | SN purif. (40 OD) | | | | Pellet purif. (20 OD) | | | | | Localization (20 OD) | | | | | |
|---|---|---|---|---|---|---|---|---|---|---|---|---|---|---|---|
| Slot | 1 | 2 | 3 | 4 | 5 | 6 | 7 | 8 | 9 | 10 | 11 | 12 | 13 | 14 | 15 |
| Sample | SN TCA 10OD | FT SN TCA 10OD | Wash SN TCA total | SN HA-ELU 1/3 15μL | FT-pellet | Wash pellet TCA Total | Pellet HA-Elu 1/3 15μL | | WCE 0.5OD | TritonX- Lysate (OD60) 1/20 20μL | TritonX- Insol. fr (OD60) 1/20 20μL | TritonX- Debris (OD60) 1/20 20μL | TritonX+ Lysate (OD60) 1/20 20μL | TritonX+ Insol. fr (OD60) 1/20 20μL | TritonX+ Debris (OD60) 1/20 20μL |

Protein Information Rituximab_LMTB (p5026)
With **secretion signal sequence and *N:* Glycosylation Site**

Light Chain
MW 25821.12 , pI 8.76 , 242 AA

MIAGSVRRGVILLLVAVAVATMAAAVSAA
QIVLSQSPAILSASPGEKVTMTCRASSSVSYIHWFQQKPGSSPKPWIYATSNLASGVPVR
FSGSGSGTSYSLTISRVEAEDAATYYCQQWTSNPPTFGGGTKLEIKRTVAAPSVFIFPPS
DEQLKSGTASVVCLLNNFYPREAKVQWKVDNALQSGNSQESVTEQDSKDSTYSLSSTLTL
SKADYEKHKVYACEVTHQGLSSPVTKSFNRGEC

Heavy Chain
MW 51978.93 , pI 8.82, 480AA

MIAGSVRRGVILLLVAVAVATMAAAVSAA
QVQLQQPGAELVKPGASVKMSCKASGYTFTSYNMHWVKQTPGRGLEWIGAIYPGNGDTSY
NQKFKGKATLTADKSSSTAYMQLSSLTSEDSAVYYCARSTYYGGDWYFNVWGAGTTVTVS
AASTKGPSVFPLAPSSKSTSGGTAALGCLVKDYFPEPVTVSWNSGALTSGVHTFPAVLQS
SGLYSLSSVVTVPSSSLGTQTYICNVNHKPSNTKVDKKAEPKSCDKTHTCPPCPAPELLG
GPSVFLFPPKPKDTLMISRTPEVTCVVVDVSHEDPEVKFNWYVDGVEVHNAKTKPREEQY
*N*STYRVVSVLTVLHQDWLNGKEYKCKVSNKALPAPIEKTISKAKGQPREPQVYTLPPSRD
ELTKNQVSLTCLVKGFYPSDIAVEWESNGQPENNYKTTPPVLDSDGSFFLYSKLTVDKSR
WQQGNVFSCSVMHEALHNHYTQKSLSLSPGK

FIG. 33

Rituximab expression cassette (7617 bps)

ENGINEERED AND FULLY-FUNCTIONAL CUSTOMIZED GLYCOPROTEINS

1. CROSS REFERENCE TO RELATED APPLICATIONS

This application is a U.S. National Stage Application under 35 U.S.C. § 371 of International Patent Application No. PCT/EP2018/067494, filed Jun. 28, 2018, which claims the benefit of priority of U.S. Provisional Application No. 62/527,466, filed Jun. 30, 2017, the entire contents of each of which are incorporated herein by reference.

2. SEQUENCE LISTING

The instant application contains a Sequence Listing which has been submitted in ASCII format and is hereby incorporated by reference in its entirety. Said ASCII copy, created on Dec. 17, 2019, is named 14197-005-999_Sequence_Listing.txt and is 1,065,574 bytes in size.

3. INTRODUCTION

Described herein are compositions and methods of producing glycosylated proteins in vitro and in vivo. The methods include using host cells to produce glycosylated proteins. Also described herein are glycosylated proteins produced using such methods and uses thereof.

4. BACKGROUND

Protein glycosylation is a ubiquitous post-translational modification found in all domains of life. There is a significant complexity in animal systems and glycan structures have crucial biological and physiological roles, from contributions in protein folding and quality, control to involvement in a large number of biological events, like recognition, stability, action, and turnover of these molecules (Moremen et al. 2012). Therapeutic Glycoproteins like monoclonal antibodies, enzymes, and hormones are the major products of the biotechnology industry (Lagassé, H A Daniel et al. 2017; Dimitrov 2012) and the impact of glycan heterogeneity has more and more been recognized as "critical quality attribute". Of the many properties determining product quality, glycosylation is regarded as even one of the most important ones: influencing the biological activity, serum half-life and immunogenicity of the protein. Glycans are relevant for increased serum circulation times and many of the biologics approved or under development suffer from an insufficient half-life necessitating frequent applications in order to maintain a therapeutic concentration over an extended period of time. Half-life extension strategies are key to allow the generation of long-lasting therapeutics with improved pharmacokinetics (Kontermann 2016). Glycosylation also appears to improve protein solubility and stability, for example, through a reduced propensity for aggregation and leads to increased circulatory lifetimes due to the prevention of proteolytic degradation. Additionally, N-glycans with different terminating monosaccharides can be recognized by lectins leading to their degradation (Blasko et al., 2013; Varki, 2017). Consequently, monitoring and control of glycosylation is critical in biopharmaceutical manufacturing and a requirement of regulatory agencies (Costa et al. 2014; Eon-Duval et al. 2012; Reusch and Tejada 2015). For these reasons, glycoengineering of expression platforms is increasingly recognized as an important strategy to improve biopharmaceuticals in many aspects (Dicker and Strasser 2015).

The majority of protein drugs are glycosylated with the attached glycan structures influencing the properties of the therapeutic protein. In general, the number and composition of the glycans play a significant role for protein folding, solubility, and intracellular trafficking. Glycans can shield the protein backbone to prevent immunogenic reactions and distinct cellular recognition events depend on the presence of specific glycan structures. Thus, glycosylation has a huge impact on the biological activity of glycoproteins and needs to be carefully controlled during manufacturing to achieve therapeutic efficacy. Dependent on the species, cell-type, and physiological status of the production host, the glycosylation pattern on recombinant glycoproteins differ significantly. Glycans on proteins are in general structurally quite diverse and consist of a set of monosaccharides that are assembled by different linkages. Mature glycans at any one glycosylation site may be as simple as a single sugar, or as complex as a polymer of more than 200 sugars, potentially modified with phosphate, sulfate, acetate, or phosphorylcholine (Stanley 2011). It has been estimated that approximately 700 proteins are required to generate the full diversity of mammalian glycans (estimated to be >7,000 structures), which are assembled from only ten monosaccharides: fucose (Fuc), galactose (Gal), glucose (Glc), N-acetylgalactosamine (GalNAc), N-acetylglucosamine (GlcNAc), glucuronic acid (GlcA), iduronic acid (IdoA), mannose (Man), sialic acid (Sia) and xylose (Xyl) (Moremen et al. 2012).

Antibody Therapeutics

Antibodies (or immunoglobulin, Ig), and particularly IgG antibodies, are some of the most successful therapeutics developed over the past decades (e.g. bevacizumab, rituximab, infliximab, adalimumab, trastuzumab, or cetuximab, many others). They are highly specific with a long serum-half life, and they can be routinely expressed in mammalian cell culture, which has been developed and improved for the past 30 years. The basic structure of an antibody molecule is assembled with two identical heavy and two identical light polypeptide chains. These chains are linked by disulfide bonds forming a "Y"-shaped structure. Human immunoglobulins are categorized into five classes, IgG, IgA, IgD, IgE, and IgM, due to their heavy chain. IgG and IgA antibodies are found as four (IgG1-4) and two subclasses (IgA1-2), respectively. Recognition of specific antigens is mediated by the antigen-binding fragment (Fab), which includes the variable regions and one constant domain of the light and heavy chains. Effector functions (FIG. 1) are initiated by binding of the fragment crystallizable region (Fc), corresponding to the other 2 domains of the constant region of the heavy chain (CH2 and CH3), to effector proteins such as Fc receptors (FcRs). Thus, the Fab fragments are comprised of variable and constant domains of light and heavy chains, while Fc fragments are comprised entirely of constant domains of heavy chains. This Fc domain also prolongs the serum half-life of antibodies due to pH-dependent binding to the neonatal Fc receptor (FcRn), which salvages the protein from being degraded in endosomes and cycles them back into circulation (Jefferis 2009).

Antibody engineering approaches have been used to further advance the clinical success of therapeutic antibodies, e.g. by altering their binding properties to ligand or Fc receptors, or by further extending their half-life. Typical approaches are introducing mutations or altering glycosylation of the antibodies. Introducing mutations in the Fc chain has the inherent disadvantage of no longer working with natural sequences. Glycosylation of therapeutic proteins is generally accepted to prolong circulating half-life, but for antibodies the studies on the effect of glycosylation on the elimination rate of Igs from circulation have led to mixed results in the past, but more recent notions suggest that glycan structural differences of the Fc moiety do affect clearance (Millward et al. 2008; Liu 2015, 2017). During post-translational modification of the antibody chains, enzymes in the endoplasmic reticulum and Golgi apparatus can attach carbohydrate chains to the polypeptide backbone of the antibody. A single N-linked glycan is present in the Fc portion of all IgG subclasses, at an asparagine at position 297. About 20% of IgG antibodies contain glycans elsewhere on the molecule. Most recombinant antibody drugs have been engineered or selected to contain only the single Fc glycosylation site.

When the antibody chains are correctly folded and associated, the oligosaccharide at position 297 is sequestered within an internal space enclosed by the CH2 domains, and there are extensive non covalent interactions between the oligosaccharide and the amino acids of antibody, resulting in influence on conformation. The oligosaccharides found at the conserved Asn-297 site are typically of a fucosylated biantennary complex type. However, among antibody molecules, there is considerable heterogeneity in the carbohydrate structures (glycoforms) due to altered branching, chain length and/or altered number of carbohydrate moieties. Indeed, the structure of the attached N-linked oligosaccharides varies considerably, depending on the degree of processing, and can include high-mannose, as well as complex biantennary oligosaccharides with or without bisecting GlcNAc and core Fucose residues (Wright and Morrison, 1997). Typically, there is heterogeneous processing of the core oligosaccharide structures attached at a given glycosylation site, with the result that even monoclonal antibodies exist as multiple glycoforms. Importantly, major differences in antibody glycosylation occur between antibody-producing cell lines, and differences are also seen for a given cell line grown under different culture conditions. Indeed, each step in mammalian N-glycan biosynthesis is <100% efficient and some enzymes compete for substrates, resulting in many different glycoforms. Heterogeneous glycosylation is recognized leading to issues in the production of therapeutic proteins. For example, glycans can affect pharmacokinetics and biological activities (Ferrara et al. 2011; Elliott et al. 2003; Krapp et al. 2003). Because N-glycans are often crucial for protein folding, these difficulties cannot be simply overcome by completely removing N-glycosylation sites or interfering with glycosylation before or in the endoplasmic reticulum. Antibodies however do not need the N-glycan for proper folding (Feige et al. 2010) but the differences in glycoforms result in different or inconsistent effector functions, which can render the antibodies difficult to use therapeutically or from a regulatory requirement. Deglycosylating the Fc moiety at N-297 can result in eliminated effector functions of the Fc containing molecules, or in reduced stability. Importantly glycoforms that are not synthesized in humans may be allergenic, immunogenic and accelerate the plasmatic clearance of the linked antibody by anti-drug antibodies that can result from repeated therapeutic dosing.

Improving the efficacy, reducing the therapeutic dosage and enhancing the overall clinical performance of the antibody by alterations in the Fc domain are the next challenges in the development of engineered antibodies. Impact on the effector functions such as antibody-dependent cell mediated cytotoxicity (ADCC), complement-dependent cytotoxicity (CDC), antibody-dependent cellular phagocytosis (ADCP) and the overall half-life of the molecule are the main aims to improve the properties of an antibody therapeutic (FIG. 1) (Jennewein and Alter 2017). The overall market is anticipated to grow aggressively with a healthy annual growth rate of nearly 40% between 2016 and 2026.

Based on the type of antibody they recognize, the Fc receptors (FcRs) are classified into different types: Fc gamma receptor (FcγR; bind to IgG), Fc alpha receptor (FcαR; bind to IgA), Fc epsilon receptors (FcεR; bind to IgE) and neonatal Fc receptor (FcRn). Of these, the most important is ‘Fc gamma’ receptors. Fc gamma receptors are responsible for activating phagocytosis of opsonized microbes. The Fc gamma receptors are further divided into classes depending on their affinity to antibodies as a result of diverse molecular structures. Some of these include FcγRI (CD64), FcγRII (CD32) and FcγRIII (CD16). FcγRIII (CD16) is present on majority of natural killer (NK) cells, granulocytes, monocytes, macrophages and on a subset of T cells. The gene encoding for this receptor is FcγRIIIa or FcγRIIIb. FcγRIIIa is the Fc receptor responsible for NK cell mediated ADCC. Fc alpha receptors consist of two extracellular Ig like domains and have only one subgroup, FcαRI (CD89). These form a part of both multi-chain immune recognition receptor (MIRR) and Ig superfamily. Fc epsilon receptors are of two types. One of the receptor is FcεRII (CD23) that is a low affinity receptor, a C-type lectin and other is FcεRI that is a high affinity receptor, a type of Ig superfamily. Neonatal receptors (FcRn) have been known to play a role in preventing lysosomal degradation of antibodies increasing the half-life of therapeutic antibodies. The FcRn in the acidic endosomes bind to IgG internalized through trans-cytosis. The IgG is recycled to the cell surface and is released at the pH of blood and is prevented from lysosomal degradation. While aglycosylation has profound impacts to effector function, the interaction of IgG-Fc with FcRn is believed to be independent of Fc glycosylation.

Figure 2A:
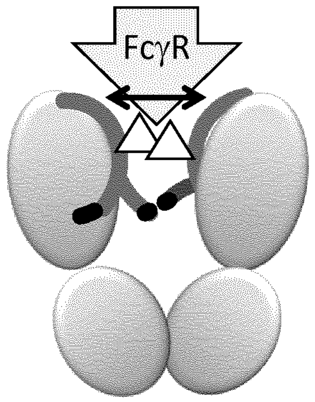
Figure 42:
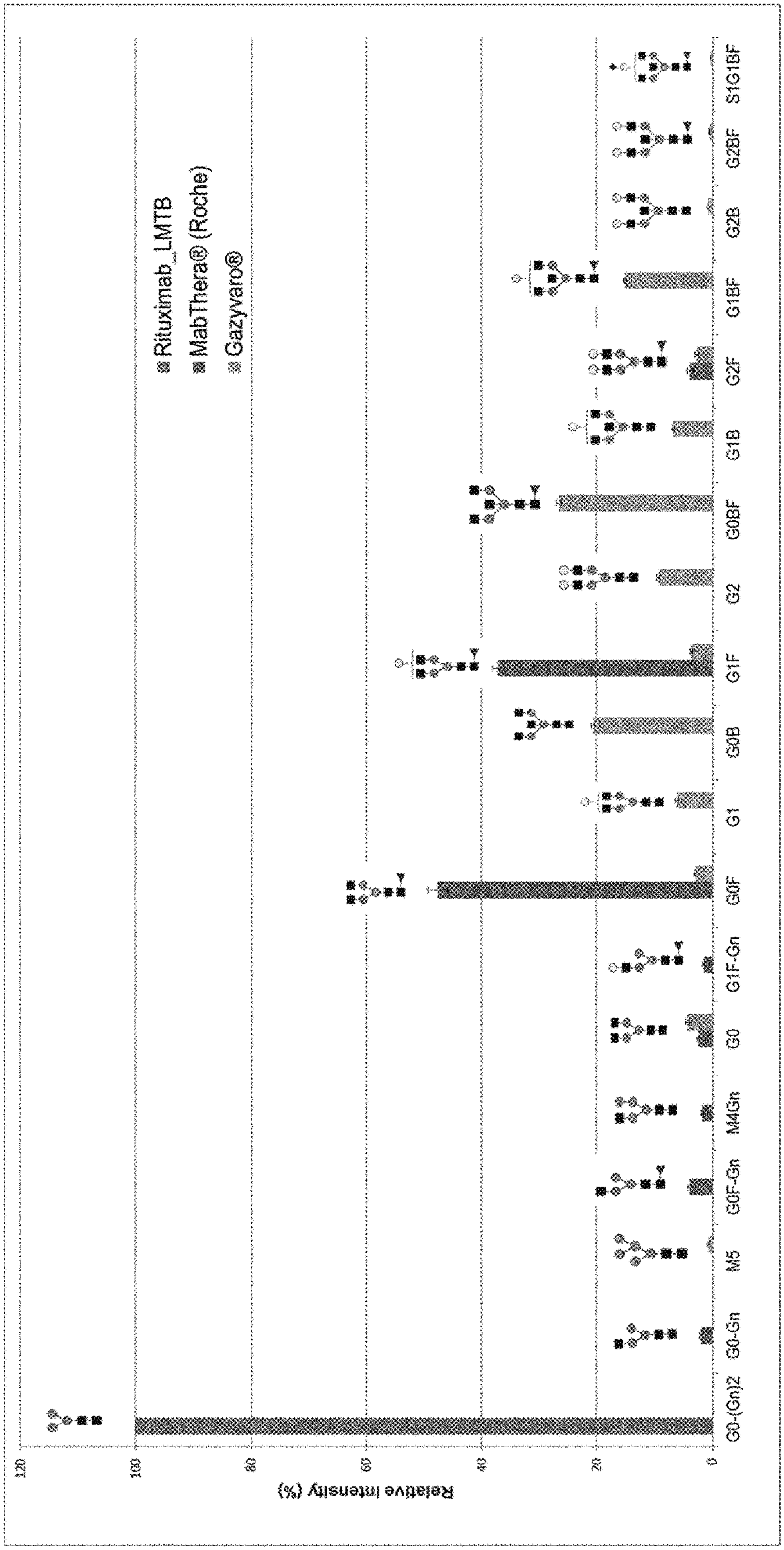

Glycans determine the “opening” of the horseshoe-shaped Fc-fragment and the truncation of the Fc glycan results in “Closed” conformation. The “open” IgG-Fc structure is the most favored conformation for interaction with FcγRIII, which was observed for the fully galactosylated but fucosylated IgG-Fc (Krapp et al. 2003). Unique carbohydrate-carbohydrate interactions are required for high affinity binding between FcγRIII and antibodies lacking core fucose. However due to a “fucose clash”, core fucosylation prevents high affinity FcγRIII binding. The fucose residue in the oligosaccharide moiety has been shown to sterically hinder the binding of therapeutic antibodies to FcγRIIIa (activating Fc receptor) (FIG. 2A). Defucosylation plays a crucial role in enhancing Fc receptor function ADCC. Importantly, (Chung et al. 2012) show that there is a linear relationship between the %-fucosylation and ADCC. This builds the case for superior properties of uniform glycans without a core fucose residue. Afucosylated antibodies were produced in a cell line overexpressing GnT-III adding a bisecting GlcNAc to the j-Man of the core, a structure which inhibits α1,6 core fucosyltransferase and leads to reduction in fucosylation. This reduction results in about 50% afucosylated structures, which was also confirmed by glycoprofiling (Gazyvaro®) (FIG. 42).

Figure 2B:
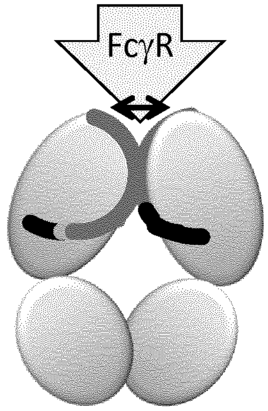

Clarifying previous data, new studies by (Li et al. 2017; Chen et al. 2017) used a chemoenzymatic approach to produce a homogeneous N-glycan and show that the FcR affinity is highly retained, even with α2,6 extended biantennary sialic acid, which translates to an improved effector function like ADCC. This data based on structurally defined and homogeneous glycans with and without α1,6 linked core fucose significantly advanced the understanding on FcR binding and the related downstream effects (Li et al. 2017; Sondermann et al. 2013) (FIG. 2B). Furthermore, the α2,3 linked sialic acid at the biantennary termini of the N-glycan did not lead to increased FcγR affinity and it can therefore be assumed to work as an inhibitory glycan by the absence of Fc receptor function on the activating pathways. Due to the sialic acid on the termini, sialic acid related effects on anti-inflammation and increase in circulatory half-life of the antibody are therefore implied. It will be advantageous to obtain antibody and Fc containing molecules that have improved properties, such as longer circulating half-life and immune-tolerization (e.g., for the avoidance of anti-drug antibodies against potentially immunogenic therapeutic mAbs), but without drawbacks such as heterogeneous glycosylation, or reduced antigen binding. Moreover, function-customized N-glycans will advance molecules for targeted downstream effector function.

The glycosylation processes in the endoplasmic reticulum (ER) and Golgi compartments of eukaryotic cells generate the majority of heterogeneous glycan structures found on recombinant glycoproteins. Due to the recognized importance in therapy, substantial efforts have been made in recent years to overcome glycan heterogeneity and to establish in vivo and in vitro glycoengineering technologies for efficient production of homogeneous therapeutic glycoproteins. Despite the progress to modify glycosylation pathways in several expression hosts to generate humanized glycans, it can be concomitant with a loss of fitness, productivity or even viability. Importantly, no in vivo system generating a defined homogeneous N-glycan has been described to date.

Expression technologies for producing such recombinant therapeutic proteins with such a defined homogeneous and even function-customized glycosylation represent therefore a new class of safe and innovative next-generation drugs with enhanced biological activity and improved properties.

N-Glycosylation Pathway

The most prominent and best characterized form of protein glycosylation is the linkage of a glycan to the amide in the side chain of an asparagine (N-glycosylation) on newly synthesized proteins. N-glycosylation of proteins starts in the lumen of the endoplasmic reticulum (ER) by transfer of a conserved oligosaccharide precursor ($Glc_3Man_9GlcNAc_2$) that got assembled on a lipid carrier to the Asn-X-Ser/Thr (where X is any amino acid except proline) consensus sequence exposed on nascent polypeptide chains. This initial glycan transfer reaction is catalyzed by the heteromeric oligosaccharyltransferase (OST) complex and is supposed to precede folding of the protein in the ER (Aebi 2013). Immediately after the oligosaccharide transfer, the two terminal glucose residues are cleaved off by glucosidase I and II and the resulting polypeptide with mono-glucosylated glycan structures ($Glc_1Man_9GlcNAc_2$) can interact with the ER-resident membrane-bound lectin calnexin or its soluble homolog calreticulin. These lectins support protein folding in a glycan-dependent protein quality control cycle. Secretory glycoproteins that have acquired their native conformation are released from the calnexin/calreticulin cycle and exit the ER to the Golgi apparatus. In the Golgi, the ER-derived oligomannosidic N-glycans on maturely folded glycoproteins are subjected to further N-glycan elongation, which generates the highly diverse complex N-glycans (Stanley 2011).

Insects, yeasts and plants generate N-glycans, which differ significantly from those produced by mammalian cells. The processing of the initial $Glc_2Man_9GlcNAc_2$ oligosaccharide to $Man_8GlcNAc_2$ in the endoplasmic reticulum shows significant similarities among these species from yeast up mammals, whereas very different processing events occur in the Golgi. For example, yeasts can add 50 or even more Man residues to $Man_{8-9}GlcNAc_2$, whereas insect cells typically remove most or all Man residues to generate paucimannosidic $Man_{3-1}GlcNAc_2$ N-glycans. Plant cells also remove Man residues to yield $Man_{4-5}GlcNAc_2$, with occasional complex GlcNAc or Gal modifications, but often add potentially immunogenic β1,2-linked xylose (Xyl) and, together with insect cells, core α1,3-linked fucose (Fuc) residues.

The N-glycans of animal glycoproteins typically include galactose, fucose, and terminal sialic acid. These sugars are not found on glycoproteins produced in yeast and filamentous fungi. In humans and other non-human eukaryotic cells, the full range of sugar nucleotide precursors (e.g. UDP-N-acetylglucosamine, UDP-N-acetylgalactosamine, CMP-N-acetylneuraminic acid, UDP-galactose, GDP-fucose, etc.) are synthesized in the cytosol and transported into the Golgi, where they are attached to the core oligosaccharide by glycosyltransferases ("Gnts").

Glycoengineering Approaches

Genetic and metabolic engineering efforts have been undertaken to modify insect, yeast and plant N-glycan processing pathways and have yielded sialylated complex-type N-glycans in insect cells, in yeasts and plants, indicating that cell lines can be engineered to produce mammalian-like glycoproteins of potential therapeutic value (Geisler et al. 2015a; Strasser 2016; Hamilton et al. 2006; Jacobs et al. 2009). Other heterologous hosts like moss, aquatic plants, algae, and silkworms were tested for beneficial glycosylation but these system are far from being optimal (Calow et al. 2016; Cox et al. 2006; Tada et al. 2015). To date, there is no reliable way of predicting whether a particular heterologously expressed glycosyltransferase in a lower eukaryote will be sufficiently translated, catalytically active or located to the proper organelle within the secretory pathway. Moreover changes in glycosylation pathways can change either cell viability and/or site occupancy of the glycoproteins leading to decreased productivity or product quality.

Sialic acids (Sia) are a group of N- or O-substituted derivatives of N-acetylneuraminic acid (Neu5Ac) which are ubiquitous in animals of the deuterostome lineage, from starfish to humans. These compounds are also identified in some other organisms, including certain bacteria, protozoa and fungi. Sialic acid biosynthesis in pathogenic bacteria and mammalian cells is well understood. Although sialic acids on the surface of pathogenic organisms are predominantly thought to be a means of evading the host immune system, these same sialic acid molecules are also involved in many processes in higher organisms, including protein targeting, cell-cell interaction, cell-substrate recognition and adhesion (Varki 2017; Vimr et al. 2004; Schauer 2000). The presence of sialic acids affects half-life of glycoproteins in vivo. For example, the importance of sialic acids has been demonstrated in studies of human erythropoietin (hEPO). The terminal sialic acid residues on the N-linked glycans of this glycoprotein prevent rapid clearance of hEPO from the blood and improve in vivo activity. Asialylated-hEPO (asialo-hEPO), which terminates in a galactose residue, has dramatically decreased erythropoietic activity in vivo. This decrease is caused by the increased clearance of the asialo-hEPO by the hepatic asialoglycoprotein receptor (Fukuda et al. 1989). Likewise, the absence of terminal sialic acid on many therapeutic glycoproteins can reduce efficacy in vivo, and thus require more frequent patient dosing regimens.

In general, the ability to generate mammalian and fully humanized N-glycans is expected to transform the biotechnology industry, as a new set of organisms will emerge to produce therapeutics valuable to human health. The invention describes the analysis of the native and novel N-glycosylation pathway in species of Kinetoplastid *Leishmania tarentolae*, discovering relevant difference to conserved pathways and the exploitation for glycoengineering. The glycoengineering approach will be presented in several examples.

This Kinetoplastida glycoengineered expression platform leads to defined and fully-customized N-glycans, and the production of cheaper, safer and more consistent therapeutics with highly homogenous humanized glycosylation due to an engineered glycan build-up on a simple human paucimannose base, significantly progresses the field of glycoengineering. The specific and surprisingly unique N-glycan biosynthesis is novel and has never been described to date, which differentiates the glycoengineering approach to any other organisms like *Pichia* or other eukaryotes. Moreover, shorter development timelines and faster generation of recombinant strains compared to mammalian cells significantly advances this simple but fully function-customizable expression platform for a wide application on therapeutic proteins.

5. SUMMARY

Described herein are unicellular Kinetoplastida eukaryotic host cells comprising heterologous glycosyltransferases, including N-acetyl glucosamine transferases, galactosyltransferase, and sialyltransferases. The host cells described herein are capable of producing mammalian (e.g., human) therapeutic glycoproteins comprising homogeneous and fully-functional customized N-glycans with a high site occupancy. The host cells provided herein can be used to express full length therapeutic antibodies (e.g. anti-CD20 (Rituximab)) and other therapeutic proteins (e.g., erythropoietin).

Also provided herein are nucleic acids and combinatorial libraries that can be used to successfully target and express mammalian enzymatic activities (such as those involved in N-acetylglucosamine elongation, galactosylation and sialylation) in intracellular compartments in kinetoplastid eukaryotic host cells. The process provides an engineered host cell, which can be used to express and target any desirable gene(s) involved in glycosylation. Design of a CMP-sialic acid biosynthetic pathway for the production of sialylated glycoproteins is also provided.

In a specific embodiment, provided herein is a *Leishmania* host cell comprising (a) a recombinant nucleic acid encoding a target protein; and (b) a recombinant nucleic acid encoding a heterologous glycosyltransferase.

In certain embodiments, the heterologous glycosyltransferase is an N-acetyl glucosamine transferase; and/or a heterologous galactosyltransferase; and/or a heterologous sialyltransferase. In some embodiments, provided herein is a host cell comprising two or more N-acetyl glucosamine transferases. In other embodiments, the host cell comprising a heterologous sialyltransferase further comprises a heterologous CMP-Sia biosynthetic pathway proteins capable of generating CMP-NeuAc.

In another embodiment, provided herein is a host cell, wherein one or more endogenous enzymes from the N-glycan biosynthesis pathway have been deleted, mutated and/or functionally inactivated.

In further embodiments, the amino acid sequence of the N-acetyl glucosamine transferase, galactosyltransferase, and/or sialyltransferase is derived from an N-acetyl glucosamine transferase, a galactosyltransferase, or a sialyltransferase listed in Table 9, or any functional homologue, isoform or variant thereof.

In further embodiments, the CMP-Sia biosynthetic pathway proteins capable of generating CMP-NeuAc are at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical to CMP-Sia biosynthetic pathway proteins listed in Table 11 or any functional homologue, isoform or variant thereof.

In another embodiment, the N-acetyl glucosamine transferase is a GnT-I. In another embodiment, the N-acetyl glucosamine transferase is a GnT-II. In another embodiment, the N-acetyl glucosamine transferases are GnT-I and GnT-II. In another embodiment, the Galactosyltransferase is B4GALT1. In a certain embodiment, provided herein is a host cell wherein the N-acetyl glucosamine transferases are GnT-I and GnT-II and the Galactosyltransferase is B4GALT1. In another embodiment, the sialyltransferase is a 2,6-SiaT or a 2,3-SiaT. In a certain embodiment, provided herein is a host cell wherein the N-acetyl glucosamine transferases are GnT-I and GnT-II, the Galactosyltransferase is B4GALT1, and the sialyltransferase is a 2,6-SiaT or a 2,3-SiaT. In a specific embodiment, provided herein is a host cell wherein the N-acetyl glucosamine transferases are GnT-I and GnT-II, the Galactosyltransferase is B4GALT1, the sialyltransferase is a 2,6-SiaT or a 2,3-SiaT, and wherein the sialyltransferase further comprises heterologous CMP-Sia biosynthetic pathway proteins capable of generating CMP-NeuAc.

In certain embodiments, the host cell is a *Leishmania tarentolae* cell. In other embodiments, the host cell is any strain listed in Table 13.

Figure 53:
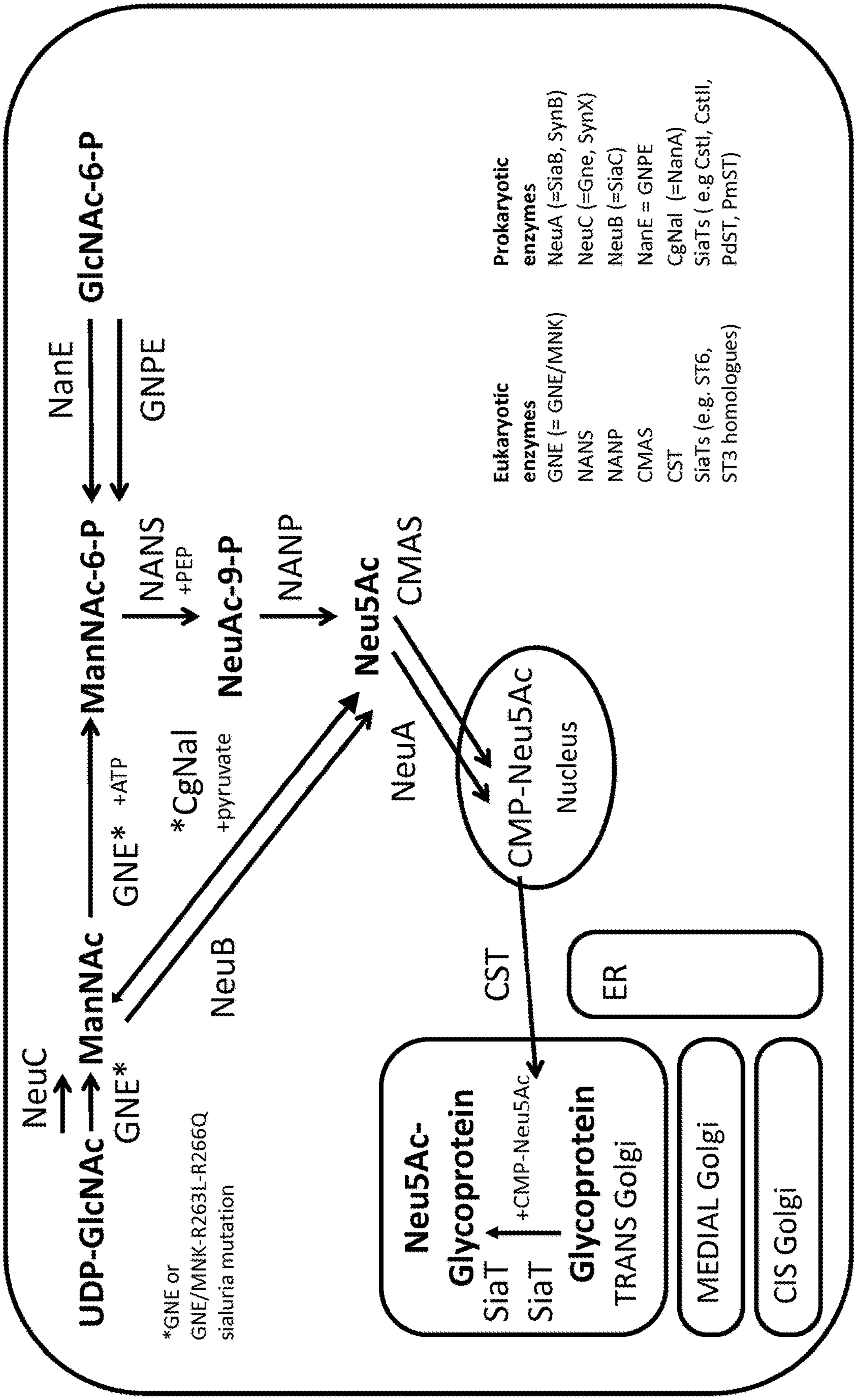

In certain embodiments, the host cell comprises a CMP-Neu5Ac pathway with prokaryotic or eukaryotic enzymes as depicted in FIG. 53.

In other embodiments, a *Leishmania* signal and/or retention sequence is added to the N-acetyl glucosamine transferase, galactosyltransferase, and/or sialyltransferase, wherein the signal sequence targets the N-acetyl glucosamine transferase, galactosyltransferase, and/or sialyltransferase to the endoplasmic reticulum of the *Leishmania* host cell, and wherein the retention sequence retains the N-acetyl glucosamine transferase, galactosyltransferase, and/or sialyltransferase in the endoplasmic reticulum or Golgi apparatus. In another embodiment, the retention sequence retains the N-acetyl glucosamine transferase and/or galactosyltransferase in the endoplasmic reticulum of the host cell. In another embodiment, the retention sequence retains the N-acetyl glucosamine transferase and/or galactosyltransferase in the cis Golgi compartment of the host cell. In another embodiment, the retention sequence retains the N-acetyl glucosamine transferase and/or galactosyltransferase in the medial Golgi compartment of the host cell. In another embodiment, the retention sequence retains the galactosyltransferase in the trans Golgi compartment of the host cell. In another embodiment, the retention sequence retains the sialyltransferase in the trans Golgi compartment of the host cell. In another embodiment, the retention sequence retains the sialyltransferase and galactosyltransferase in the trans Golgi compartment of the host cell.

In another embodiment, provided herein is a host cell, wherein one or more endogenous enzymes from the N-glycan biosynthesis pathway have been deleted, mutated and/or functionally inactivated.

In another embodiment, the signal sequence and/or retension sequence is a signal sequence or retention sequence derived from any *Leishmania* species. In further embodiments, the signal sequence and/or retention sequence is a signal sequence or retention sequence derived from *Leishmania tarentolae.*

In another embodiment, the signal sequence is processed and removed.

In further embodiments, the retention sequence is a cytoplasmic-transmembrane-stem (CTS) sequence derived from a *Leishmania tarentolae* protein. In another embodiment, the CTS sequence is derived from *Leishmania tarentolae* MAN1, NTPDase 1, or NTPDase 2. In another embodiment, the CTS sequence comprises the sequence of SEQ ID NO: 24, SEQ ID NO: 25, or SEQ ID NO: 26 or functionally active fragments thereof. In yet another embodiment, the CTS sequence comprises a sequence that is at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical to the sequence of SEQ ID NO: 24 or a functionally active fragment thereof; a sequence that is at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical to the sequence of SEQ ID NO: 25 or a functionally active fragment thereof; or a sequence that is at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical to the sequence of SEQ ID NO: 26 or a functionally active fragment thereof.

In another embodiment, the CTS is derived from *Leishmania tarentolae* MAN1. In another embodiment, the CTS sequence comprises the sequence of SEQ ID NO: 24 or functionally active fragments thereof. In further embodiments, the retention sequence comprises a GRIP sequence derived from *Leishmania* or functionally active fragments thereof. In another embodiment, the GRIP sequence comprises the sequence of SEQ ID NO: 27, or a functionally active fragments thereof. In yet another embodiment, the GRIP sequence comprises a sequence that is at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical to the sequence of SEQ ID NO: 27 or a functionally active fragment thereof. In further embodiments, the retention sequence comprises a CTS sequence derived from a *Leishmania* protein, or a functionally active fragment thereof, and a GRIP sequence derived from *Leishmania* or a functionally active fragment thereof.

In other embodiments, the target protein is heterologous to the *Leishmania* host cell.

In another embodiment, the target protein has been engineered to comprise a signal sequence from *Leishmania*. In other embodiment, said signal sequence is a signal sequence from *Leishmania tarentolae*. In some embodiments, the signal sequence comprises the sequence of SEQ ID NO: 28, or SEQ ID NO: 29 or functionally active fragments thereof. In a specific embodiment, the signal sequence comprises the sequence of SEQ ID NO: 28 or a functionally active fragment thereof. In yet another embodiment, The signal sequence comprises a sequence that is at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical to the sequence of SEQ ID NO: 28 or a functionally active fragment thereof. In other embodiments, the signal sequence is processed and removed from the target protein.

In other embodiments, the target protein comprises the amino acid sequence of human Interferon-α (INF-α), Interferon-β (INF-β), Interferon-γ (INF-γ), Interleukin-2 (IL2), Chimeric diphteria toxin-IL-2 (Denileukin diftitox), Interleukin-1 (IL1), IL1B, IL3, IL4, IL11, IL21, IL22, IL1 receptor antagonist (anakinra), Tumor necrosis factor alpha (TNF-α), Insulin, Pramlintide, Growth hormone (GH), Insulin-like growth factor (IGF1), Human parathyroid hormone, Calcitonin, Glucagon-like peptide-1 agonist (GLP-1), Glucagon, Growth hormone-releasing hormone (GHRH), Secretin, Thyroid stimulating hormone (TSH), Human bone morphogenic protein 2 (hBMP2), Human bone morphogenic protein 7 (hBMP7), Gonadotropin releasing hormone (GnRH), Keratinocyte growth factor (KGF), Platelet-derived growth factor (PDGF), Fibroblast growth factor 7 (FGF7), Fibroblast growth factor 20 (FGF20), Fibroblast growth factor 21 (FGF21), Epidermal growth factor (EGF), Vascular endothelial growth factor (VEGF), Neurotrophin-3, Human follicle-stimulating hormone (FSH), Human chorionic gonadotropin (HCG), Lutropin-α, Erythropoietin, Granulocyte colony-stimulating factor (G-CSF), Granulocyte-macrophage colony-stimulating factor (GM-CSF), the extracellular domain of CTLA4 (e.g., an FC-fusion), or the extracellular domain of TNF receptor (e.g., an FC-fusion).

In other embodiments, the target protein is a therapeutic protein. In other embodiments, the target protein is an Fc-fusion protein. In other embodiments, the target protein is an antibody.

In another embodiment, the target protein is an antibody against a human protein. In further embodiments, the antibody has the amino acid sequence of adalimumab (Humira); Remicade (Infliximab); ReoPro (Abciximab); Rituxan (Rituximab); Simulect (Basiliximab); Synagis (Palivizumab); Herceptin (Trastuzumab); Mylotarg (Gemtuzumab ozogamicin); Campath (Alemtuzumab); Zevalin (Ibritumomab tiuxetan); Xolair (Omalizumab); Bexxar (Tositumomab-I-131); Erbitux (Cetuximab); Avastin (Bevacizumab); Tysabri (Natalizumab); Actemra (Tocilizumab); Vectibix (Panitumumab); Lucentis (Ranibizumab); Soliris (Eculizumab); Cimzia (Certolizumab pegol); Simponi (Golimumab); Ilaris (Canakinumab); Stelara (Ustekinumab); Arzerra (Ofatumumab); Prolia (Denosumab); Numax (Motavizumab); ABThrax (Raxibacumab); Benlysta (Belimumab); Yervoy (Ipilimumab); Adcetris (Brentuximab Vedotin); Perjeta (Pertuzumab); Kadcyla (Ado-trastuzumab emtansine); or Gazyva (Obinutuzumab).

In other embodiments, the antibody is a full length antibody, an Fab, an F(ab')2, an Scfv, or a sdAb. In other embodiments, the target protein comprises the amino acid sequence of an enzyme or an inhibitor thereof. In another embodiment, the target protein comprises the amino acid sequence of Factor VII, Factor VIII, Factor IX, Factor X, Factor XIII, Factor VIIa, Antithrombin III (AT-III), Protein C, Tissue plasminogen activator (tPA) and tPA variants, Urokinase, Hirudin, Streptokinase, Glucocerebrosidase, Alglucosidase-α, Laronidase (α-L-iduronidase), Idursulphase (Iduronate-2-sulphatase), Galsulphase, Agalsidase-β (human α-galactosidase A), Botulinum toxin, Collagenase, Human DNAse-I, Hyaluronidase, Papain, L-Asparaginase, Uricase (Urate oxidase), glutamate carboxypeptidase (glucarpidase), α1 Protease inhibitor (α1 antitrypsin), Lactase, Pancreatic enzymes (lipase, amylase, protease), and Adenosine deaminase.

In another embodiment, the therapeutic protein comprises the amino acid sequence of Abatacept (e.g., Orencia), Aflibercept (e.g., Eylea), Agalsidase beta (e.g., Fabrazyme), Albiglutide (e.g., Eperzan), Aldesleukin (e.g., Proleukin), Alefacept (e.g., Amevive), Alglucerase (e.g., Ceredase), Alglucosidase alfa (e.g., LUMIZYME), Aliskiren (e.g., Tekturna), Alpha-1-proteinase inhibitor (e.g., Aralast), Alteplase (e.g., Activase), Anakinra (e.g., Kineret), Anistreplase (e.g., Eminase), Anthrax immune globulin human (e.g., ANTHRASIL), Antihemophilic Factor (e.g., Advate), Anti-inhibitor coagulant complex (e.g., Feiba Nf), Antithrombin Alfa, Antithrombin III human, Antithymocyte globulin (e.g., Antithymocyte globulin), Anti-thymocyte Globulin (Equine) (e.g., ATGAM), Anti-thymocyte Globulin (Rabbit) (e.g., ATG-Fresenius), Aprotinin (e.g., Trasylol), Asfotase Alfa, Asparaginase (e.g., Elspar), Asparaginase *Erwinia chrysanthemi* (e.g., Erwinaze), Becaplermin (e.g., REGRANEX), Belatacept (e.g., Nulojix), Beractant, Bivalirudin (e.g., Angiomax), Botulinum Toxin Type A (e.g., BOTOXE), Botulinum Toxin Type B (e.g., Myobloc), Brentuximab vedotin (e.g., Adcetris), Buserelin (e.g., Suprecur), C1 Esterase Inhibitor (Human), C1 Esterase Inhibitor (Recombinant) (e.g., Ruconest), Certolizumab pegol (e.g., Cimzia), Choriogonadotropin alfa (e.g., Choriogonadotropin alfa), Chorionic Gonadotropin (Human) (e.g., Ovidrel), Chorionic Gonadotropin (Recombinant) (e.g., Ovitrelle), Coagulation factor ix (e.g., Alprolix), Coagulation factor VIIa (e.g., NovoSeven), Coagulation factor X human (e.g., Coagadex), Coagulation Factor XIII A-Subunit (Recombinant), Collagenase (e.g., Cordase), Conestat alfa, Corticotropin (e.g., H.P. Acthar), Cosyntropin (e.g., Cortrosyn), Darbepoetin alfa (e.g., Aranesp), Defibrotide (e.g., Noravid), Denileukin diftitox (e.g., Ontak), Desirudin, Digoxin Immune Fab (Ovine) (e.g., DIGIBIND), Dornase alfa (e.g., Pulmozyme), Drotrecogin alfa (e.g., Xigris), Dulaglutide, Efmoroctocog alfa (e.g., ELOCTA), Elosulfase alfa, Enfuvirtide (e.g., FUZEON), Epoetin alfa (e.g., Binocrit), Epoetin zeta (e.g., Retacrit), Eptifibatide (e.g., INTEGRILIN), Etanercept (e.g., Enbrel), Exenatide (e.g., Byetta), Factor IX Complex (Human) (e.g., AlphaNine), Fibrinolysin aka plasmin (e.g., Elase), Filgrastim (e.g., N.A.), Filgrastim-sndz, Follitropin alfa (e.g., Gonal-F), Follitropin beta (e.g., Follistim AQ), Galsulfase (e.g., Naglazyme), Gastric intrinsic factor, Gemtuzumab ozogamicin (e.g., Mylotarg), Glatiramer acetate (e.g., Copaxone), Glucagon recombinant (e.g., GlucaGen), Glucarpidase (e.g., Voraxaze), Gramicidin D (e.g., Neosporin), Hepatitis B immune globulin, Human calcitonin, Human *Clostridium tetani* toxoid immune globulin, Human rabies virus immune globulin (e.g., Hyperab Rabies Immune Globulin Human), Human Rho(D) immune globulin (e.g., Hyp Rho D Inj 16.5%), Human Serum Albumin (e.g., Albuminar), Human Varicella-Zoster Immune Globulin (e.g., Varizig), Hyaluronidase (e.g., HYLENEX), Hyaluronidase (Human Recombinant), Ibritumomab tiuxetan (e.g., Zevalin), Idursulfase (e.g., Elaprase), Imiglucerase (e.g., Cerezyme), Immune Globulin Human, Insulin aspart (e.g., NovoLog), Insulin Beef, Insulin Degludec (e.g., Tresiba), Insulin detemir (e.g., LEVEMIR), Insulin Glargine (e.g., Lantus), Insulin glulisine (e.g., APIDRA), Insulin Lispro (e.g., Humalog), Insulin Pork (e.g., Iletin II), Insulin Regular (e.g., Humulin R), Insulin, porcine (e.g., vetsulin), Insulin, isophane (e.g., Novolin N), Interferon Alfa-2a, Recombinant (e.g., Roferon A), Interferon alfa-2b (e.g., INTRON A), Interferon alfacon-1 (e.g., INFERGEN), Interferon alfa-nl (e.g., Wellferon), Interferon alfa-n3 (e.g., Alferon), Interferon beta-1a (e.g., Avonex), Interferon beta-1b (e.g., Betaseron), Interferon gamma-1b (e.g., Actimmune), Intravenous Immunoglobulin (e.g., Civacir), Laronidase (e.g., Aldurazyme), Lenograstim (e.g., Granocyte), Lepirudin (e.g., Refludan), Leuprolide (e.g., Eligard), Liraglutide (e.g., Saxenda), Lucinactant (e.g., Surfaxin), Lutropin alfa (e.g., Luveris), Mecasermin (e.g., N. A.), Menotropins (e.g., Menopur), Methoxy polyethylene glycol-epoetin beta (e.g., Mircera), Metreleptin (e.g., Myalept), Natural alpha interferon OR multiferon (e.g., Intron/Roferon-A), Nesiritide (e.g., NATRECOR), Ocriplasmin (e.g., Jetrea), Oprelvekin (e.g., Neumega), OspA lipoprotein (e.g., Lymerix), Oxytocin (e.g., Pitocin), Palifermin (e.g., Kepivance), Pancrelipase (e.g., Pancrecarb), Pegademase bovine (e.g., Adagen), Pegaspargase (e.g., Oncaspar), Pegfilgrastim (e.g., Neulasta), Peginterferon alfa-2a (e.g., Pegasys), Peginterferon alfa-2b (e.g., PEG-Intron), Peginterferon beta-1a (e.g., Plegridy), Pegloticase (e.g., (Krystexxa)), Pegvisomant (e.g., SOMAVERT), Poractant alfa (e.g., Curosurf), Pramlintide (e.g., Symlin), Preotact (e.g., PreotactE), Protamine sulfate (e.g., Protamine Sulfate Injection, USP), Protein S human (e.g., Protein S human), Prothrombin (e.g., Feiba Nf), Prothrombin complex (e.g., Cofact), Prothrombin complex concentrate (e.g., Kcentra), Rasburicase (e.g., Elitek), Reteplase (e.g., Retavase), Rilonacept (e.g., Arcalyst), Romiplostim (e.g., Nplate), Sacrosidase (e.g., Sucraid), Salmon Calcitonin (e.g., Calcimar), Sargramostim (e.g., Leucomax), Satumomab Pendetide (e.g., OncoScint), Sebelipase alfa (e.g., Kanuma), Secretin (e.g., SecreFlo), Sermorelin (e.g., Sermorelin acetate), Serum albumin (e.g., Albunex), Serum albumin iodonated (e.g., Megatope), Simoctocog Alfa (e.g., Nuwiq), Sipuleucel-T (e.g., Provenge), Somatotropin Recombinant (e.g., NutropinAQ), Somatropin recombinant (e.g., BioTropin), Streptokinase (e.g., Streptase), Susoctocog alfa (e.g., Obizur), Taliglucerase alfa (e.g., Elelyso), Teduglutide (e.g., Gattex), Tenecteplase (e.g., TNKase), Teriparatide (e.g., Forteo), Tesamorelin (e.g., Egrifta), Thrombomodulin Alfa (e.g., Recomodulin), Thymalfasin (e.g., Zadaxin), Thyroglobulin, Thyrotropin Alfa (e.g., Thyrogen), Tuberculin Purified Protein Derivative (e.g., Aplisol), Turoctocog alfa (e.g., Zonovate), Urofollitropin (e.g., BRAVELLE), Urokinase (e.g., Kinlytic), Vasopressin (e.g., Pitressin), Velaglucerase alfa (e.g., Vpriv), Abciximab (e.g., ReoPro), Adalimumab (e.g., Humira), Alemtuzumab (e.g., CAMPATH), Alirocumab (e.g., Praluent), Arcitumomab (e.g., CEA-Scan), Atezolizumab (e.g., Tecentriq), Basiliximab (e.g., Simulect), Belimumab (e.g., Benlysta), Bevacizumab (e.g., Avastin), Blinatumomab (e.g., Blincyto), Brodalumab (e.g., Siliq), Canakinumab (e.g., ILARISE), Canakinumab (e.g., Ilaris), Capromab (e.g., ProstaScint), Cetuximab (e.g., Erbitux), Daclizumab (e.g., Zenapax), Daratumumab (e.g., DARZALEX), Denosumab (e.g., Xgeva), Dinutuximab (e.g., unituxin), Eculizumab (e.g., Soliris), Efalizumab (e.g., RAPTIVA), Elotuzumab (e.g., EMPLICITI), Evolocumab (e.g., Repatha), Golimumab (e.g., Simponi Injection), Ibritumomab (e.g., Zevalin), Idarucizumab (e.g., Praxbind), Infliximab (e.g., REMICADE), Ipilimumab (e.g., YERVOY), Ixekizumab (e.g., Taltz), Mepolizumab (e.g., Nucala), Muromonab (e.g., ORTHOCLONE OKT3), Natalizumab (e.g., Tysabri), Necitumumab (e.g., Portrazza), Nivolumab (e.g., Opdivo), Obiltoxaximab (e.g., Anthim), Obinutuzumab (e.g., Gazyva), Ofatumumab (e.g., Arzerra), Omalizumab (e.g., Xolair), Palivizumab (e.g., Synagis), Panitumumab (e.g., Vectibix), Pembrolizumab (e.g., Keytruda), Pertuzumab (e.g., Perjeta), Ramucirumab (e.g., Cyramza), Ranibizumab (e.g., Lucentis), Raxibacumab (e.g., RAXIBACUMAB), Rituximab (e.g., Rituxan), Secukinumab (e.g., Cosentyx), Siltuximab (e.g., Sylvant), Tocilizumab (e.g., ACTEMRA), Tositumomab (e.g., Bexxar), Trastuzumab (e.g., Herceptin), Ustekinumab (e.g., Stelara), or Vedolizumab (e.g., Entyvio).

In further embodiments, the host cell comprises (a) an Stt3 oligosaccharyltransferase (OST), and (b) does not have endogenous N-glycan elongation.

Another embodiment includes a method for making a glycosylated target protein, wherein the method comprises culturing a host cell, and purifying the target protein from the culture.

Another embodiment includes a composition of glycosylated target proteins.

In another embodiment, the composition of glycosylated target proteins have at least about 90% to 100% of the N-linked glycosylation consensus sequences of the target proteins in the composition carry an oligosaccharide comprising the following structure:

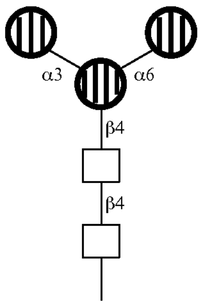

wherein the square represents an N-acetylglucosamine residue and the circle with vertical lines as fill pattern represents a mannose residue; and wherein the Asn is the Asn of the N-linked glycosylation consensus sequence in the target protein.

In another embodiment, the composition of glycosylated target proteins have at least about 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is G0-Gn glycan, characterized by the following structure:

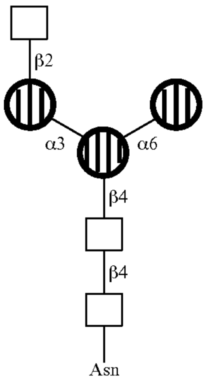

wherein the square represents an N-acetylglucosamine residue and the circle with vertical lines as fill pattern represents a mannose residue; and wherein the Asn is an Asn of an N-linked glycosylation consensus sequence in the target protein.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is G0 glycan, characterized by the following structure:

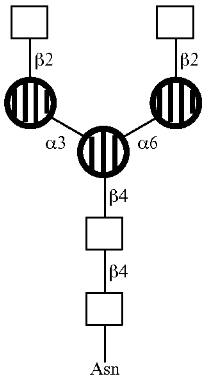

wherein the square represents an N-acetylglucosamine residue and the circle with vertical lines as fill pattern represents a mannose residue; and wherein the Asn is an Asn of an N-linked glycosylation consensus sequence in the target protein.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is G1-Gn glycan, characterized by the following structure:

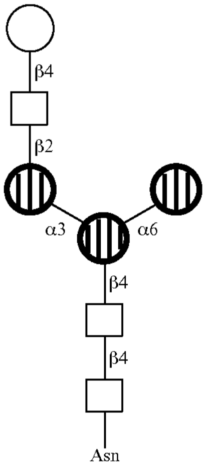

wherein the empty circle represents a galactose residue, the square represents an N-acetylglucosamine residue and the circle with vertical lines as fill pattern represents a mannose residue; and wherein the Asn is an Asn of an N-linked glycosylation consensus sequence in the target protein.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is G2 glycan, characterized by the following structure:

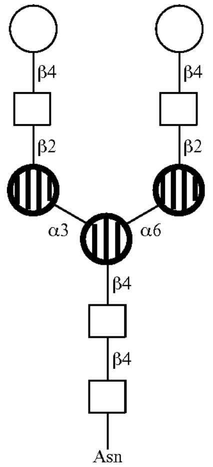

wherein the empty circle represents a galactose residue, the square represents an N-acetylglucosamine residue and the circle with vertical lines as fill pattern represents a mannose residue; and wherein the Asn is an Asn of an N-linked glycosylation consensus sequence in the target protein.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is G1 glycan, characterized by the following structure:

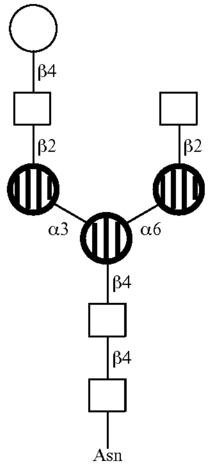

wherein the empty circle represents a galactose residue, the square represents an N-acetylglucosamine residue and the circle with vertical lines as fill pattern represents a mannose residue; and wherein the Asn is an Asn of an N-linked glycosylation consensus sequence in the target protein.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is G1 glycan, characterized by the following structure:

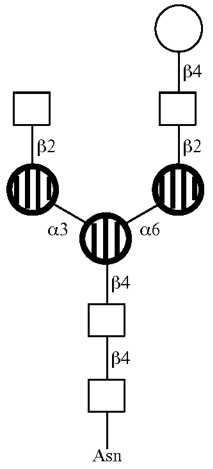

wherein the empty circle represents a galactose residue, the square represents an N-acetylglucosamine residue and the circle with vertical lines as fill pattern represents a mannose residue; and wherein the Asn is an Asn of an N-linked glycosylation consensus sequence in the target protein.

In another embodiment, the glycosylation on the target protein is further modified to optimize the pharmacokinetic properties of the target protein when introduced into a subject. In another embodiment, the glycosylation on the target protein is sialylated.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is characterized by the following structure:

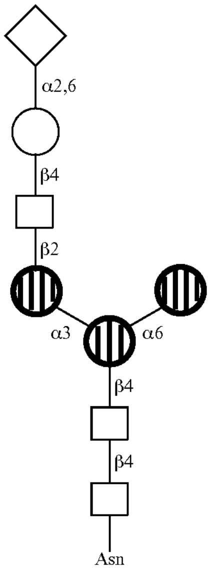

wherein the diamond represents a sialic acid residue, the empty circle represents a galactose residue, the square represents an N-acetylglucosamine residue and the circle with vertical lines as fill pattern represents a mannose residue; and wherein the Asn is an Asn of an N-linked glycosylation consensus sequence in the target protein.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is characterized by the following structure:

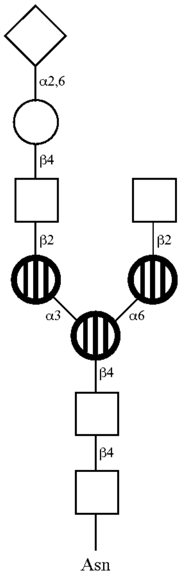

wherein the diamond represents a sialic acid residue, the empty circle represents a galactose residue, the square represents an N-acetylglucosamine residue and the circle with vertical lines as fill pattern represents a mannose residue; and wherein the Asn is an Asn of an N-linked glycosylation consensus sequence in the target protein.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is characterized by the following structure:

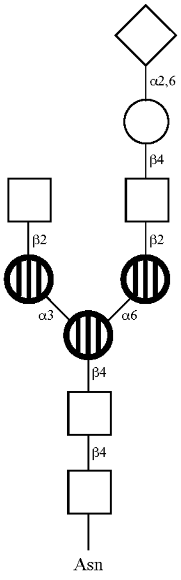

wherein the diamond represents a sialic acid residue, the empty circle represents a galactose residue, the square represents an N-acetylglucosamine residue and the circle with vertical lines as fill pattern represents a mannose residue; and wherein the Asn is an Asn of an N-linked glycosylation consensus sequence in the target protein.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is characterized by the following structure:

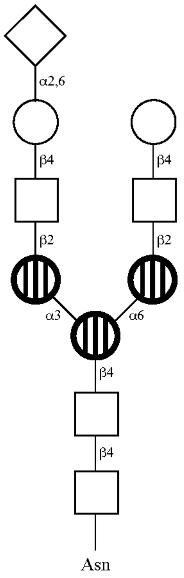

wherein the diamond represents a sialic acid residue, the empty circle represents a galactose residue, the square represents an N-acetylglucosamine residue and the circle with vertical lines as fill pattern represents a mannose residue; and wherein the Asn is an Asn of an N-linked glycosylation consensus sequence in the target protein.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is characterized by the following structure

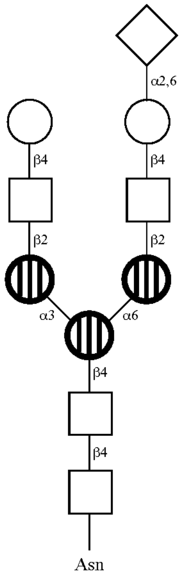

wherein the diamond represents a sialic acid residue, the empty circle represents a galactose residue, the square represents an N-acetylglucosamine residue and the circle with vertical lines as fill pattern represents a mannose residue; and wherein the Asn is an Asn of an N-linked glycosylation consensus sequence in the target protein.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is characterized by the following structure:

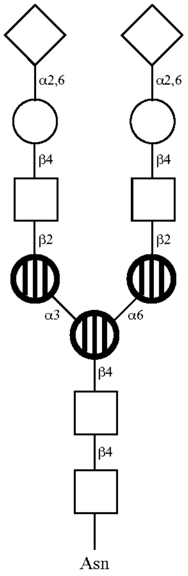

wherein the diamond represents a sialic acid residue, the empty circle represents a galactose residue, the square represents an N-acetylglucosamine residue and the circle with vertical lines as fill pattern represents a mannose residue; and wherein the Asn is an Asn of an N-linked glycosylation consensus sequence in the target protein.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is characterized by the following structure:

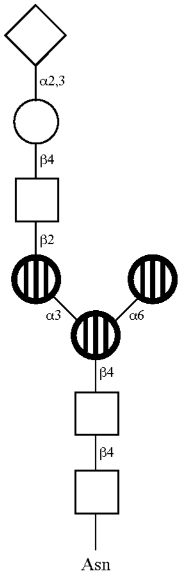

wherein the diamond represents a sialic acid residue, the empty circle represents a galactose residue, the square represents an N-acetylglucosamine residue and the circle with vertical lines as fill pattern represents a mannose residue; and wherein the Asn is an Asn of an N-linked glycosylation consensus sequence in the target protein.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is characterized by the following structure:

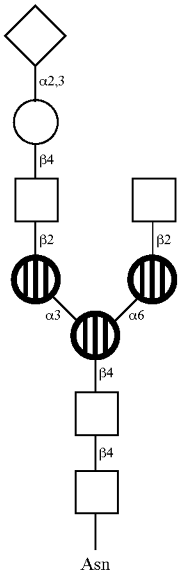

wherein the diamond represents a sialic acid residue, the empty circle represents a galactose residue, the square represents an N-acetylglucosamine residue and the circle with vertical lines as fill pattern represents a mannose residue; and wherein the Asn is an Asn of an N-linked glycosylation consensus sequence in the target protein.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is characterized by the following structure:

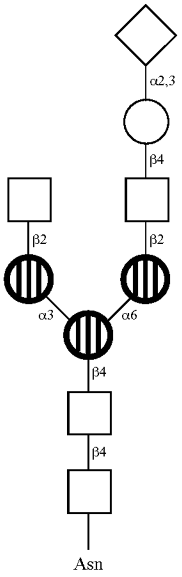

wherein the diamond represents a sialic acid residue, the empty circle represents a galactose residue, the square represents an N-acetylglucosamine residue and the circle with vertical lines as fill pattern represents a mannose residue; and wherein the Asn is an Asn of an N-linked glycosylation consensus sequence in the target protein.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is characterized by the following structure:

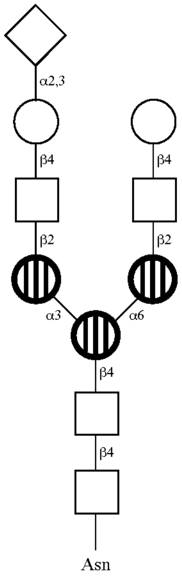

wherein the diamond represents a sialic acid residue, the empty circle represents a galactose residue, the square represents an N-acetylglucosamine residue and the circle with vertical lines as fill pattern represents a mannose residue; and wherein the Asn is an Asn of an N-linked glycosylation consensus sequence in the target protein.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is characterized by the following structure:

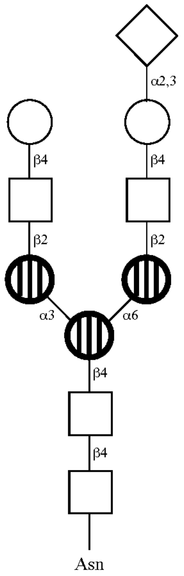

wherein the diamond represents a sialic acid residue, the empty circle represents a galactose residue, the square represents an N-acetylglucosamine residue and the circle with vertical lines as fill pattern represents a mannose residue; and wherein the Asn is an Asn of an N-linked glycosylation consensus sequence in the target protein.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is characterized by the following structure:

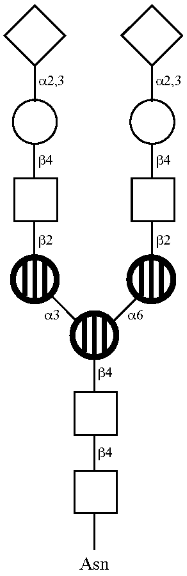

wherein the diamond represents a sialic acid residue, the empty circle represents a galactose residue, the square represents an N-acetylglucosamine residue and the circle with vertical lines as fill pattern represents a mannose residue; and wherein the Asn is an Asn of an N-linked glycosylation consensus sequence in the target protein.

In another embodiment, the N-linked glycosylation consensus sequence is Asn-X-Ser/Thr; wherein X is any amino acid except proline.

In another embodiment, the glycosylated target protein is secreted into the culture media, and wherein the glycosylated target protein is glycosylated. In certain embodiments, the glycosylated target protein is purified from the culture media. In another embodiment, the glycosylated target protein is purified from the culture media via affinity purification or ion exchange chromatography. In another embodiment, the glycosylated target protein contains an FC domain and is affinity purified from the culture media via protein-A. In another embodiment, the glycosylated target protein contains an affinity tag and is affinity purified.

In another embodiment, the population of glycosylated target protein is at least about 90%, 91%, 92%, 93%, 94%, 95%, 96%, 97%, 98%, 99%, or 100% homogeneous. In further embodiments, 90% to 100% of the N-glycosites on the target proteins that are occupied by glycosylation.

In a specific embodiment, provided herein is a hybrid N-acetyl glucosamine transferase, wherein the hybrid N-acetyl glucosamine transferase comprises (a) catalytic domain of an N-acetyl glucosamine transferase that is not from *Leishmania*; and (b) amino acid sequence(s) responsible for localization and retention in the Golgi compartment of *Leishmania*.

In certain embodiments, the hybrid N-acetyl glucosamine transferase is from *Leishmania tarentolae*.

In other embodiments, the hybrid N-acetyl glucosamine transferase has been engineered to comprise a signal sequence and at least one retention sequence, wherein the signal sequence targets the N-acetyl glucosamine transferase to the endoplasmic reticulum of the *Leishmania tarentolae* host cell, and wherein the retention sequence retains the N-acetyl glucosamine transferase in the endoplasmic reticulum or Golgi apparatus.

In another embodiment, the hybrid N-acetyl glucosamine transferase retains the N-acetyl glucosamine transferase in the endoplasmic reticulum. In another embodiment, the hybrid N-acetyl glucosamine transferase retains the N-acetyl glucosamine transferase in the cis Golgi apparatus. In another embodiment, the hybrid N-acetyl glucosamine transferase retains the N-acetyl glucosamine transferase in the medial Golgi apparatus. In further embodiments, the hybrid N-acetyl glucosamine transferase is a cytoplasmic-transmembrane-stem (CTS) sequence.

In certain other embodiments, the N-acetyl glucosamine transferase is derived from an N-acetyl glucosamine transferase listed in Table 9, or a functional homologue, isoform or variant thereof.

In a specific embodiment, provided herein is a hybrid galactosyltransferase, wherein the hybrid galactosyltransferase comprises (a) catalytic domain of an galactosyltransferase that is not from *Leishmania*; and (b) amino acid sequence(s) responsible for localization and retention in the endoplasmic reticulum or Golgi compartment of *Leishmania*.

In another embodiment, the hybrid galactosyltransferase is from *Leishmania tarentolae*.

In further embodiments, the hybrid galactosyltransferase has been engineered to comprise a signal sequence, wherein the signal sequence targets the galactosyltransferase to the endoplasmic reticulum of the *Leishmania tarentolae* host cell, and wherein the retention sequence retains the galactosyltransferase in the endoplasmic reticulum or Golgi apparatus.

In certain embodiments, the hybrid galactosyltransferase retains the galactosyltransferase in the endoplasmic reticulum. In certain embodiments, the hybrid galactosyltransferase retains the galactosyltransferase in the cis Golgi apparatus. In another embodiment, the hybrid galactosyltransferase retains the galactosyltransferase in the medial Golgi apparatus. In another embodiment, the hybrid galactosyltransferase retains the galactosyltransferase in the trans Golgi apparatus. In other embodiments, the hybrid galactosyltransferase is a cytoplasmic-transmembrane-stem (CTS) sequence. In further embodiments, the hybrid sialyltransferase is a GRIP sequence. In certain embodiments, the hybrid sialyltransferase is a CTS sequence and a GRIP sequence.

In other embodiments, the galactosyltransferase is derived from an galactosyltransferase listed in Table 9, or a functional homologue, isoform or variant thereof.

In a specific embodiment, provided herein is a hybrid sialyltransferase, wherein the hybrid sialyltransferase comprises (a) catalytic domain of an sialyltransferase that is not from *Leishmania*; and (b) amino acid sequence(s) responsible for localization and retention in the endoplasmic reticulum or Golgi compartment of *Leishmania.*

In another embodiment, the hybrid sialyltransferase is from *Leishmania tarentolae.*

In certain embodiments, the hybrid sialyltransferase has been engineered to comprise a signal sequence, wherein the signal sequence targets the sialyltransferase to the endoplasmic reticulum of the *Leishmania tarentolae* host cell, and wherein the retention sequence retains the sialyltransferase in the endoplasmic reticulum or Golgi apparatus.

In certain embodiments, the hybrid galactosyltransferase retains the galactosyltransferase in the endoplasmic reticulum. In another embodiment, the hybrid sialyltransferase retains the sialyltransferase in the trans Golgi apparatus. In another embodiment, the hybrid sialyltransferase is a CTS sequence. In further embodiments, the hybrid sialyltransferase is a GRIP sequence. In other embodiments, the hybrid sialyltransferase is a CTS sequence and a GRIP sequence.

In certain other embodiments, the hybrid sialyltransferase is derived from an sialyltransferase listed in Table 9, or a functional homologue, isoform or variant thereof.

In other embodiments, provided herein is a nucleic acid encoding the hybrid N-acetyl glucosamine transferase. In further embodiments, provided herein is a nucleic acid encoding the hybrid galactosyltransferase. In certain embodiments, provided herein is a nucleic acid encoding the hybrid sialyltransferase.

5.1 Terminology and Abbreviations

The term "about," when used in conjunction with a number, refers to any number within ±1, ±5 or +10% of the referenced number.

As used herein, the term "subject" refers to an animal (e.g., birds, reptiles, and mammals). In another embodiment, a subject is a mammal including a non-primate (e.g., a camel, donkey, zebra, cow, pig, horse, goat, sheep, cat, dog, rat, and mouse) and a primate (e.g., a monkey, chimpanzee, and a human). In certain embodiments, a subject is a non-human animal. In some embodiments, a subject is a farm animal or pet (e.g., a dog, cat, horse, goat, sheep, pig, donkey, or chicken). In a specific embodiment, a subject is a human. The terms "subject" and "patient" may be used herein interchangeably.

The abbreviations "α[number]", "α[number], [number]", "β[number]", or "β[number], [number]" refer to glycosidic bonds or glycosidic linkages which are covalent bonds that join a carbohydrate residue to another group. An α-glycosidic bond is formed when both carbons have the same stereochemistry, whereas a β-glycosidic bond occurs when the two carbons have different stereochemistry.

6. BRIEF DESCRIPTION OF THE DRAWINGS

FIG. 1: Antibody Combinatorial Diversity Drives Antibody Effector Function adapted from (Jennewein and Alter 2017). The IgG Fc is modified through two changes to the Fc domain of an antibody: (i) choice of glycosylation (36 options) and (ii) choice of subclass (four subclasses), creating 144 theoretical combinations and linked functional states. Depending on the antibody-glycan combination, many different functional responses may be elicited including the induction of an anti-inflammatory response; functional responses such as antibody-dependent cellular phagocytosis (ADCP), antibody-dependent cellular cytotoxicity (ADCC); or inflammatory responses including complement activation and cytokine secretion. Abbreviation: IL, interleukin.

Figure 2C:
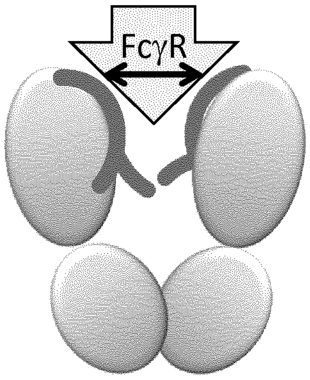

FIGS. 2A, 2B and 2C: Structural changes upon glycosylation of IgG Fc fragments adapted from (Sondermann et al. 2013). FIG. 2A: Cartoon of the proposed structural changes within the Fc fragment upon sialylation. The nongalactosylated (G0F) Fc-fragment maintains an open conformation that allows the binding of FcγRs. Triangle represent fucose and the low binding. FIG. 2B: In the fully α2,6-sialylated Fc (G2FS2), the α1,3-arm associates with the protein core of the Cγ2 domain, inducing a closed conformation. The resulting closed conformation of the Fc fragment with a changed tertiary structure reveals the binding site for DC-SIGN, whereas that for FcγRs is blocked. FIG. 2C: According to (Chen et al. 2017; Li et al. 2017) the model can be adapted to having an open conformation upon glycoengineeredN-glycans that are devoid of fucose, which allows a higher affinity binding to FcγR. When the fucose free N-glycans are biantennary terminated with sialic acid, the conformation changes can be open and compact. The Fc structure is stabilized by two glycan latches to maintain the proper conformation of Fc but mediated by different glycan residues. Chen's result suggests the role of N-glycosylation in maintaining the structure integrity of Fc and showed the possibility of diverse modes in glycan-glycan interactions with a modulation by terminal sialic acid.

Figure 3B:
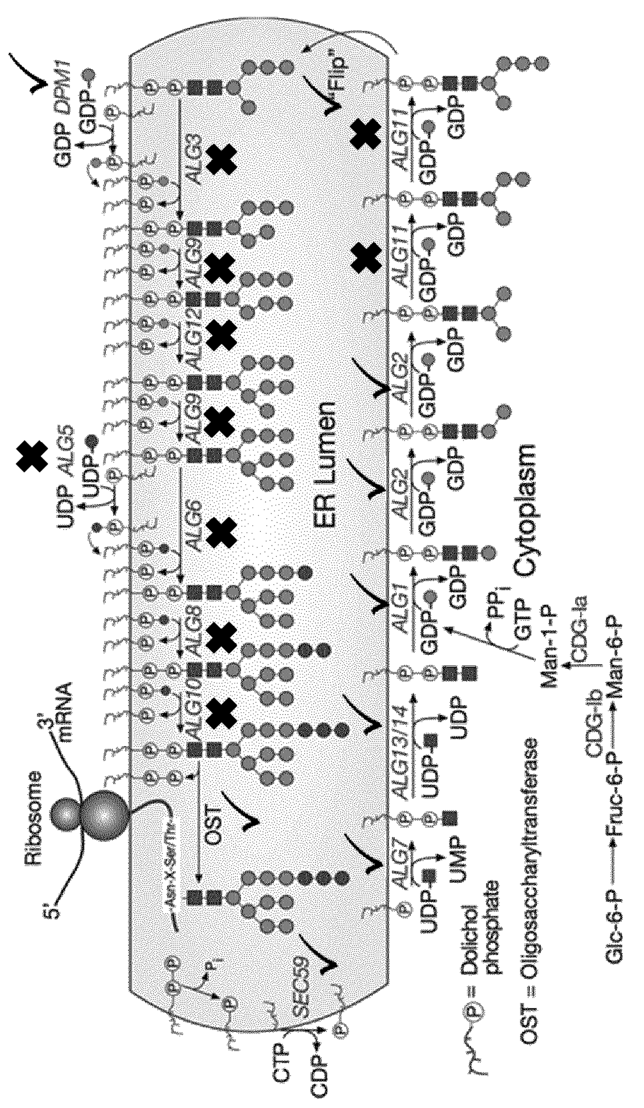
Figure 3A:
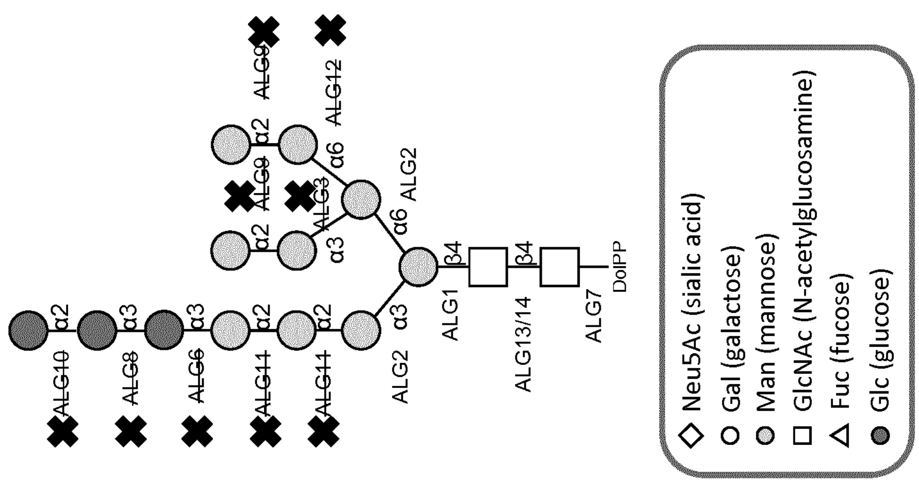

FIGS. 3A and 3B: Bioinformatic evaluation of endoplasmic reticulum (ER) N-glycan biosynthesis in *Leishmania tarentolae* and comparison to conserved pathway adapted from (Varki 2009). FIG. 3A: Absent genes in *Leishmania tarentolae* are indicated with a cross and strike through. FIG. 3B: The enzymes that catalyze each step in the biosynthesis have been identified primarily from studies of mutants of the yeast *Saccharomyces cerevisiae*. The gene affected by each yeast mutation is known as an ALG gene (for altered in glycosylation). Synthesis of dolichol-P-P-$GlcNAc_2Man_9Glc_3$. Dolichol (red squiggle) phosphate (Dol-P) located on the cytoplasmic face of the ER membrane receives GlcNAc-1-P from UDP-GlcNAc in the cytoplasm to generate Dol-P-P-GlcNAc. Dol-P-P-GlcNAc is extended to Dol-P-P-$GlcNAc_2Man_5$ by the indicated ALG enzymes, before being "flipped" across the ER membrane to the luminal side. On the luminal face of the ER membrane, four mannose residues are added from Dol-P-Man and three glucose residues from Dol-P-Glc. Dol-P-Man and Dol-P-Glc are also made on the cytoplasmic face of the ER and "flipped" onto the luminal face. The homologues present in *L. tarentolae* are noted with a tick and the absent homologues are depicted with a cross. A man3 structure is expected to be flipped and directly transferred to a polypeptide, without further mannosylation, as ALG12, 6, 8, 9 and 10 are absent, and ALG3 is presumed to contain a loss-of-function mutation. ALG5 (Dolichyl-Phosphate Beta-Glucosyltransferase) is absent. OST is only composed of Stt3 (Table 4).

Figure 4A:
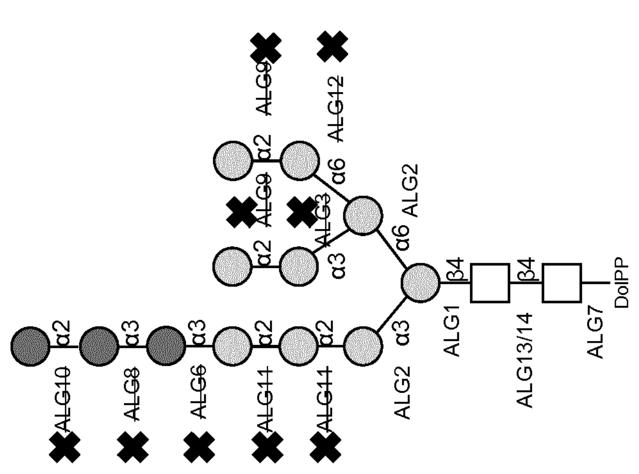
Figure 4B:
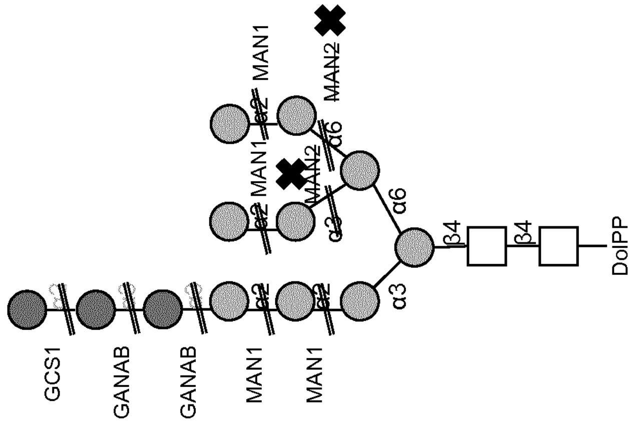
Figure 4C:
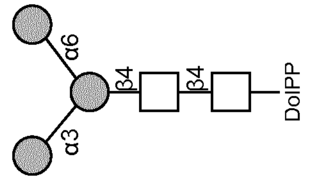

FIGS. 4A, 4B and 4C: Bioinformatic evaluation of endoplasmic reticulum (ER) N-glycan biosynthesis, trimming and transfer to protein acceptor. FIG. 4A: Absence of ALG homologues in the biosynthesis indicated with a cross, and strike though suggest a reduced Man3 precursor. Despite the presumed absence of any Man4 or Man5 precursor species (due to absence of ALG3, 9, 11, 12) and glucosylated precursor species (due to absence of ALG6, 8 and 10 and ALG5), there are trimming enzymes (GCS1, GNAB, MAN1) present (absent enzymes are indicated with a strike through), shown in FIG. 4B. FIG. 4C: Only final glycan Man3 is expected to be transferred to N-consensus site of protein acceptor by Stt3. Folding intermediate Glc1Man9GlcNAc2 is not expected for quality control as ligands of responsible lectins.

Figure 5:
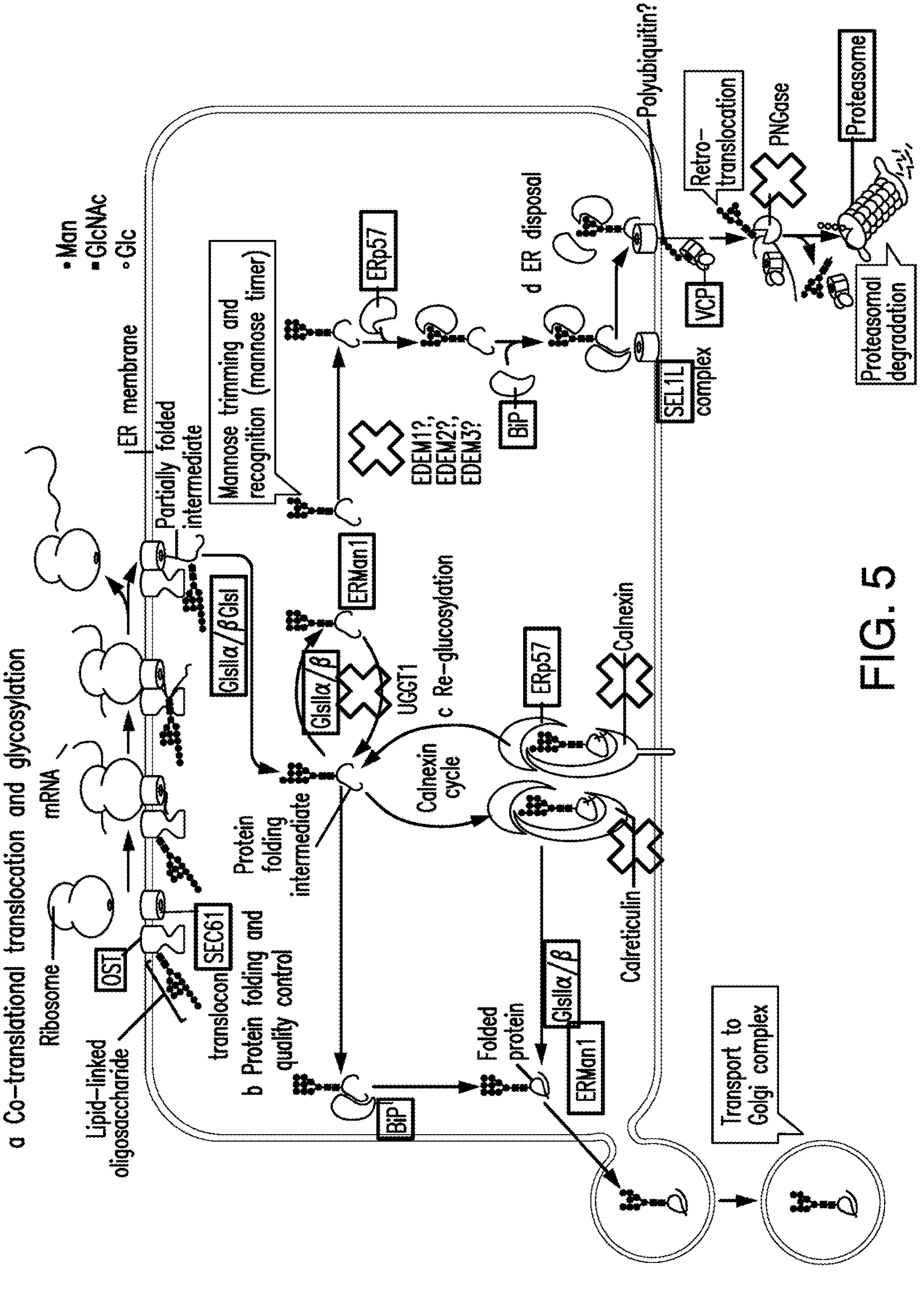

FIG. 5: Bioinformatic evaluation of Protein N-glycosylation and quality control of protein folding based on (Moremen et al. 2012). a) During glycoprotein biosynthesis, the translation of nascent polypeptides is followed by their translocation through the SEC61 pore and the simultaneous transfer of a glycan from a lipid-linked intermediate to peptide acceptor sequons by the oligosaccharyltransferase (OST). One cleft in the STT3 subunit of OST scans for Asn-X-Ser/Thr acceptor sequons, while an adjacent cleft binds the glycan donor. b) Glycan trimming through Glc removal occurs immediately after transfer by α-glucosidase I (GIsI) and the α-glucosidase II α-β heterodimer (GIsIIα/β). Folding intermediates containing Glc1Man9GlcNAc2 structures are ligands for the lectins calnexin (absent in *L. tarentolae*) or calreticulin (absent in *L. tarentolae*), which function in complex with ERp57. Dissociation from the lectins is followed by further Glc cleavage. Additional chaperone assistance is provided by the ATP-driven chaperone BiP (also known as GRP78). Correctly folded glycoproteins are packaged for transport to the Golgi. c) Incompletely folded glycoproteins are recognized by the folding sensor UDP-Glc:glycoprotein glucosyltransferase (UGGT1, absent in *L. tarentolae*). They are then re-glucosylated through the addition of a Glc residue back to the glycan structure and are reintegrated into the calnexin cycle. d) Terminally misfolded glycoproteins are subjected to endoplasmic reticulum (ER) disposal by Man trimming (through the activity of ER α-mannosidase I (ERManI,=MAN1, present in *L. tarentolae*) or GolgiManIA, GolgiManIB and GolgiManIC (not shown), followed by the activity of ER degradation-enhancing α-mannosidase-like 1 (EDEM1), EDEM2 and EDEM3 (which are homologues of Htm1 also known as Mnl1 in yeast, all absent in *L. tarentolae*). The trimmed glycans bind ER lectins OS9 or XTP3B (not shown) and are translocated into the cytosol via a complex of derlin 1 (DER1), DER2 and DER3 (the SEL1 L complex; Hrd3 in yeast) using the driving force of the cytosolic ubiquitin binding protein and ATPase functions of valocin-containing protein (VCP; also known as TER ATPase;

known as Cdc48, Ufdl or Npl4 in yeast). The peptide is deglycosylated by a cytosolic PNGase (absent in *L. tarentolae*) and degraded by the proteasome149. Homologues absent *L. tarentolae* are indicated with the cross and present homologues are depicted in boxes. For more details on the comparison refer also to Table 8.

Figure 6:
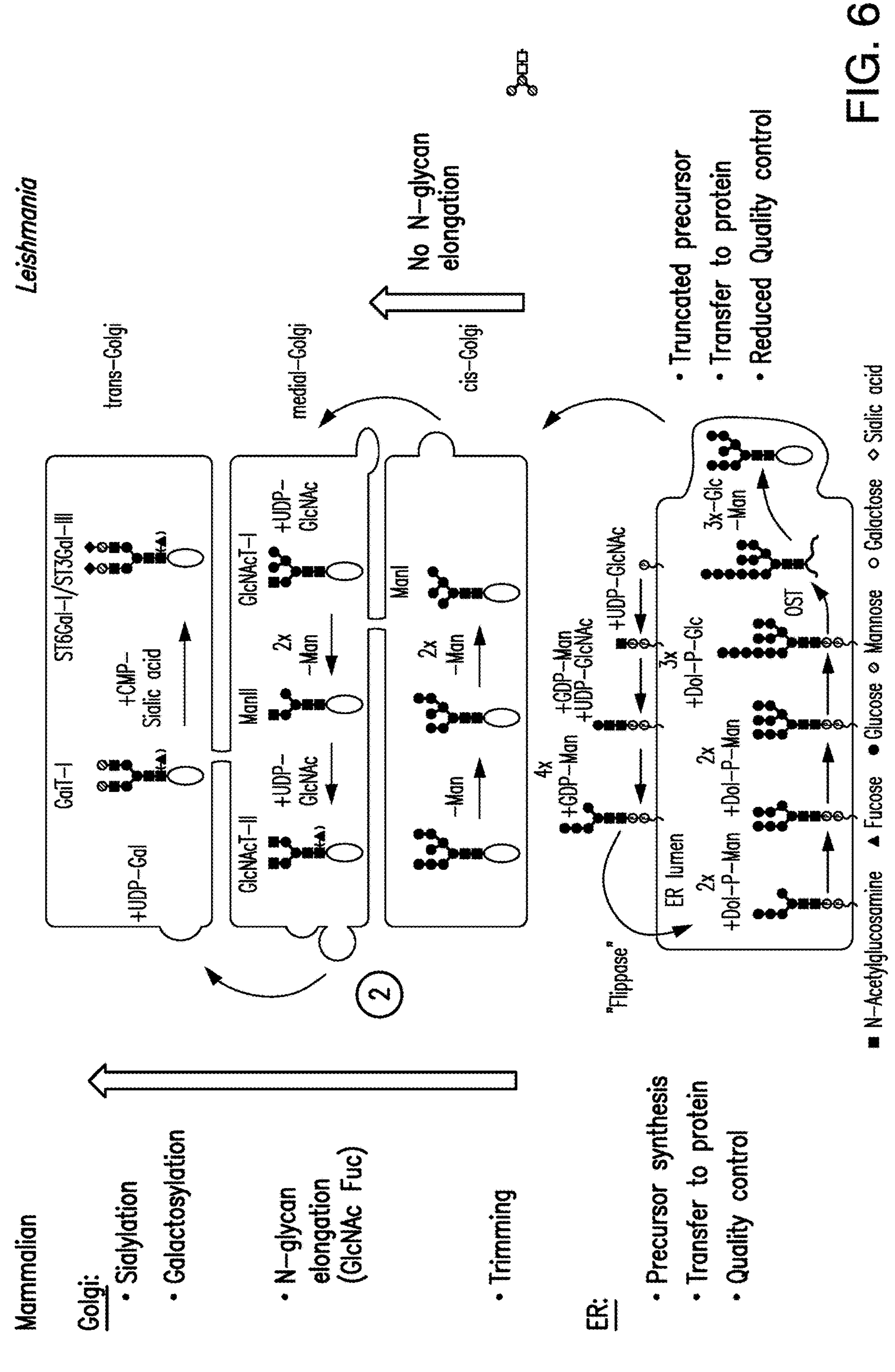

FIG. 6: The mammalian N-glycosylation pathway adapted from (Kellokumpu et al. 2016) in comparison to wild type *Leishmania tarentolae*. Schematic cartoon shows the sequential processing of N-glycans by glycosyltransferases in the endoplasmic reticulum (ER) and the Golgi. The enzymes (glycosyltransferases and glycosidases) involved are traditionally thought to function separately one after the other by adding or removing sugar residues one at the time in a specified order to and from the growing oligosaccharide chain, left side ("mammalian"). Right side of FIG. 6 represents wildtype *Leishmania tarentolae* that has reduced precursors and a different mature N-glycan compared to mammalian systems.

Figure 7:
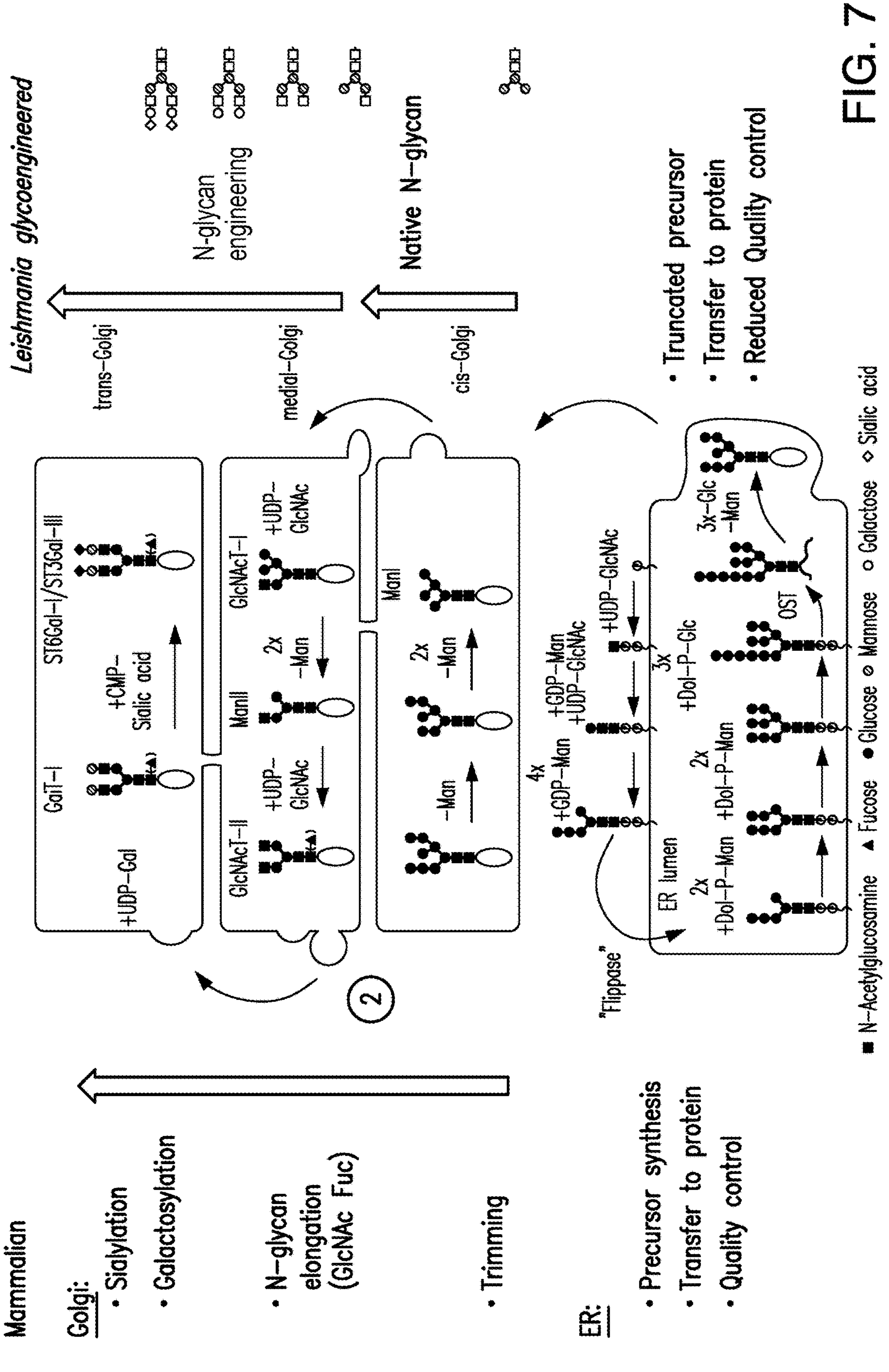

FIG. 7: The mammalian N-glycosylation pathway adapted from (Kellokumpu et al. 2016) in comparison to wild type *Leishmania tarentolae*. Schematic cartoon of mammalian pathway complements FIG. 6 with the glycoengineering steps that will produce indicated glycans in glycoengineered *Leishmania.*

Figure 8:
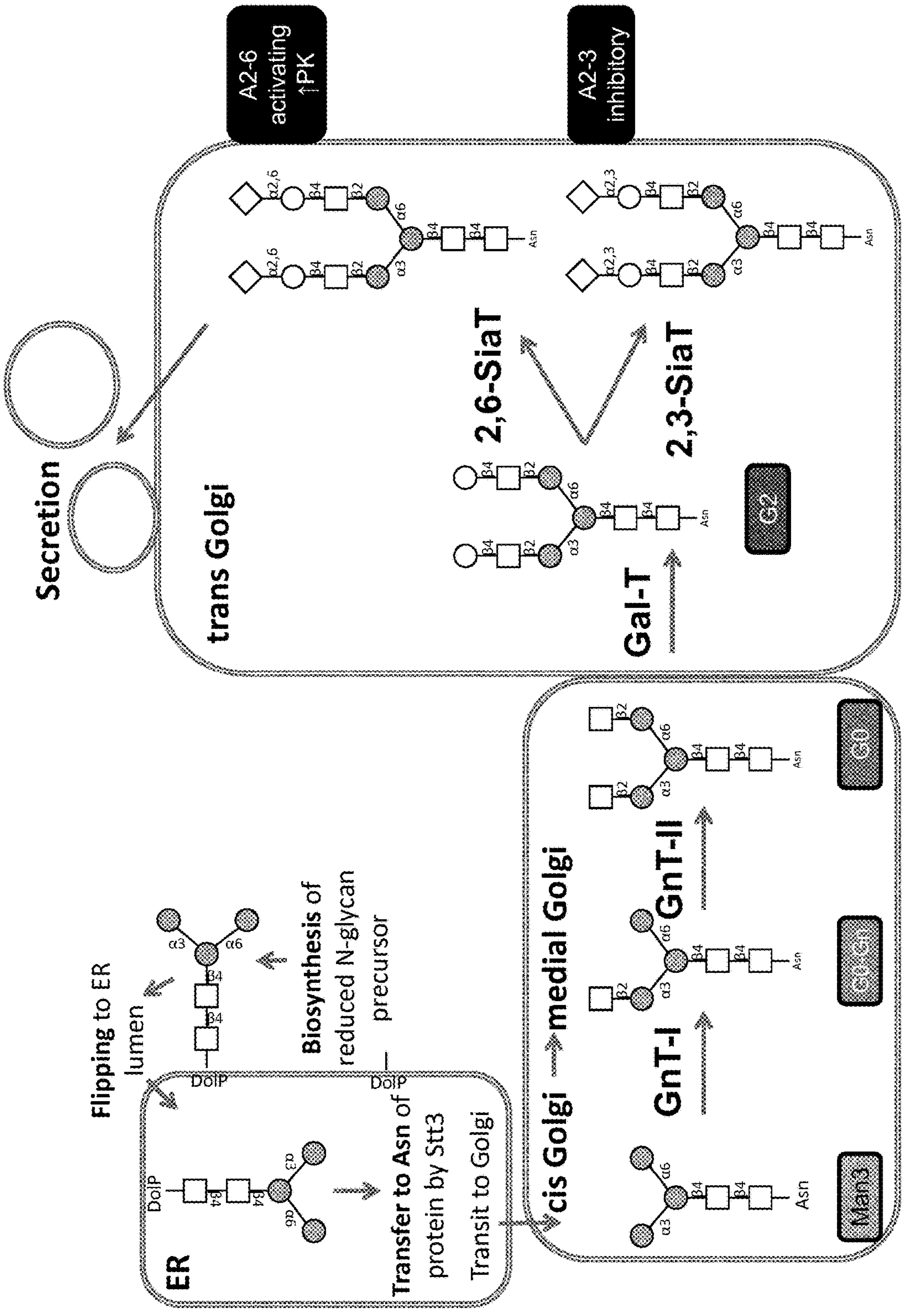

FIG. 8: The proposed N-glycosylation biosynthesis pathway in *Leishmania tarentolae*. The N-glycan precursor is assembled as Man3 at the cytoplasmic side of the ER and then flipped to the ER lumen. This Man3 glycan is then directly transferred by the Stt3, the only part of the usually found OST complex. The final glycan on the N-glycosite of the acceptor protein is Man3, which transits to the Cis Golgi. In the cis Golgi, the heterologous enzymes catalyze the glycosyltransferase reactions building up the human biantennary N-glycans. These are Gnt-I and Gnt-II from mammalian or insect source that add the first two GlcNAc residues. The corresponding glycoforms are described with their text abbreviation in the boxes below. In the trans Golgi, the GalT and SiaT enzymes, from mammalian source expressed in *Leishmania* catalyze the reactions to the completion of the N-glycan, which is then the homogeneous the fucose-free but biantennary sialylated humanized glycans mediating different expected functions depending on α2,3 or α2,6 linked sialic acid (Neu5Ac).

Figure 9:
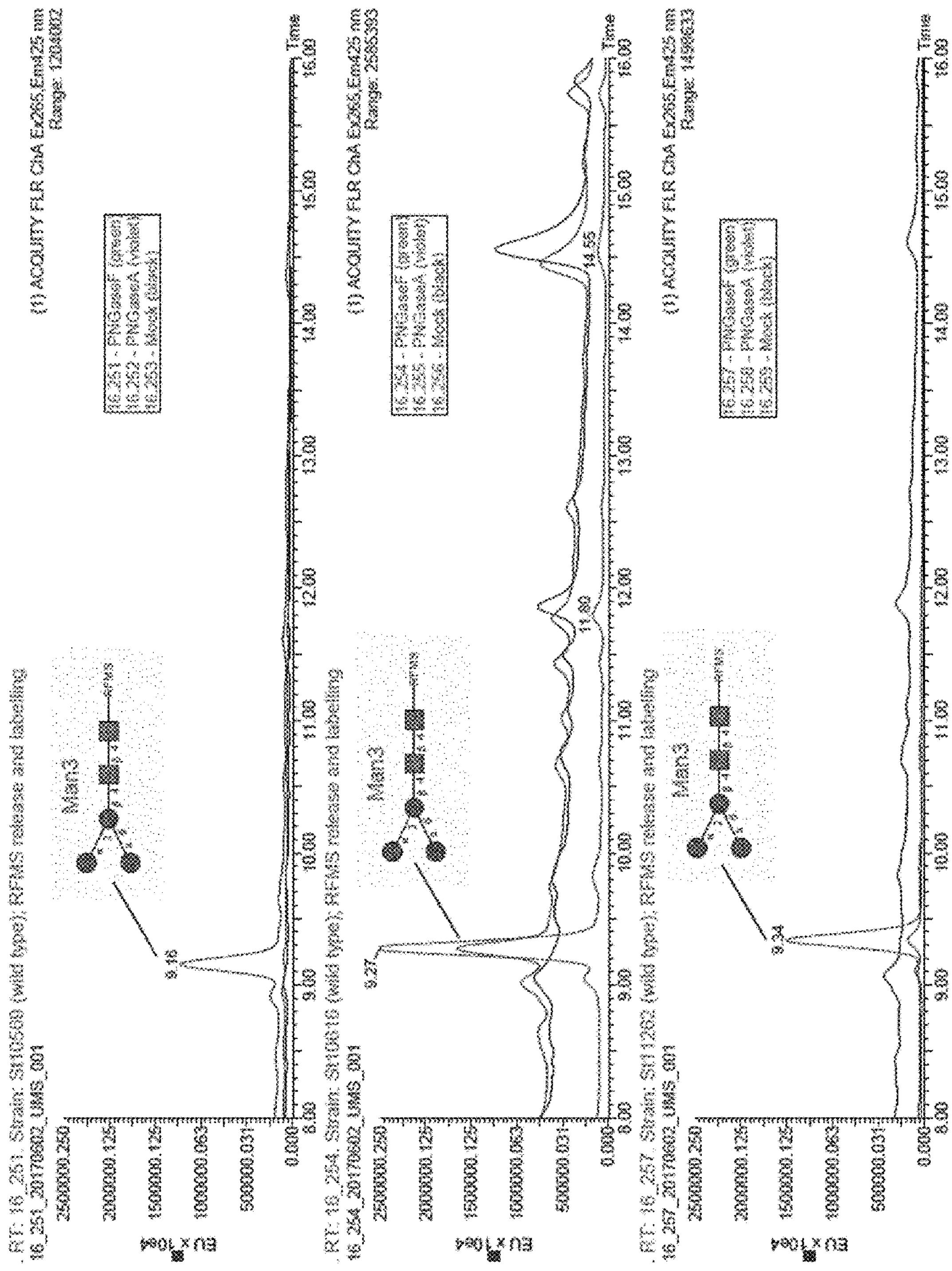

FIG. 9: UPLC separation and m/z determination by MS of PNGase F or PNGase A released and RF labeled N-glycans or mock treated from total *Leishmania tarentolae* cell pellets in three different wt strains. $(Man)_3(GlcNAc)_2$=Man3 was detected by MS with calculated m/z=1222.7166; $[M+Na]^+$ 1244.6985; $[M+K]^+$ 1260.6724. Man3 was observed in all the pellet samples, when release with PNGase F or PNGase A RT of 9.16; 9.27; 9.34, but not in the mock treated samples. Mock treated samples show contaminations in strains (middle and bottom panel) e.g. from cell wall glycolipids (with poly hexose signatures). At RT 15.76 another peak was observed in the FLR trace, but although a good MS spectrum was obtained the compound could not be identified. Generally there is not much background observed in the FLR trace, but quite some background in the MS trace at early RT (<8 min RT, not shown).

Figure 10A:
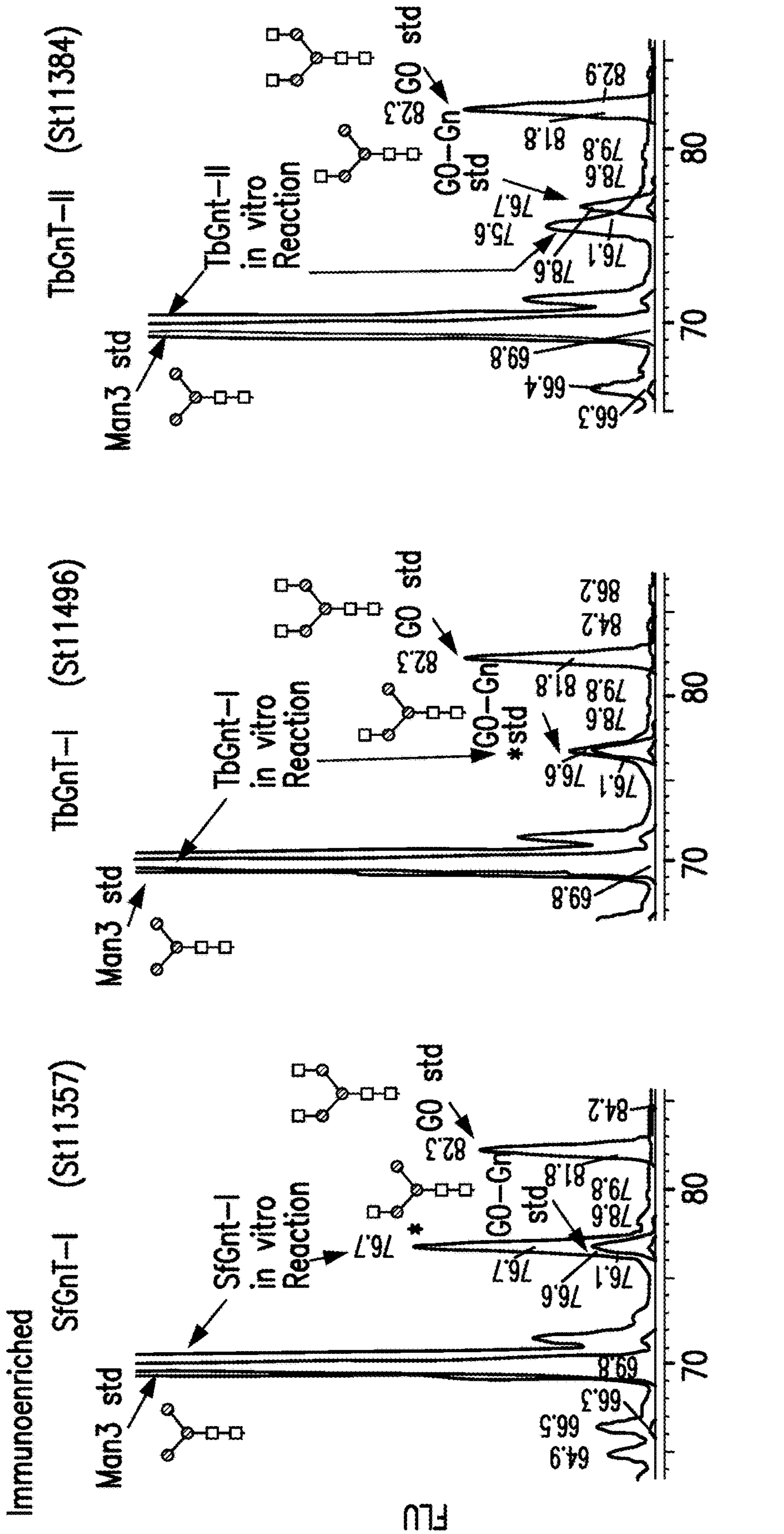
Figure 10B:
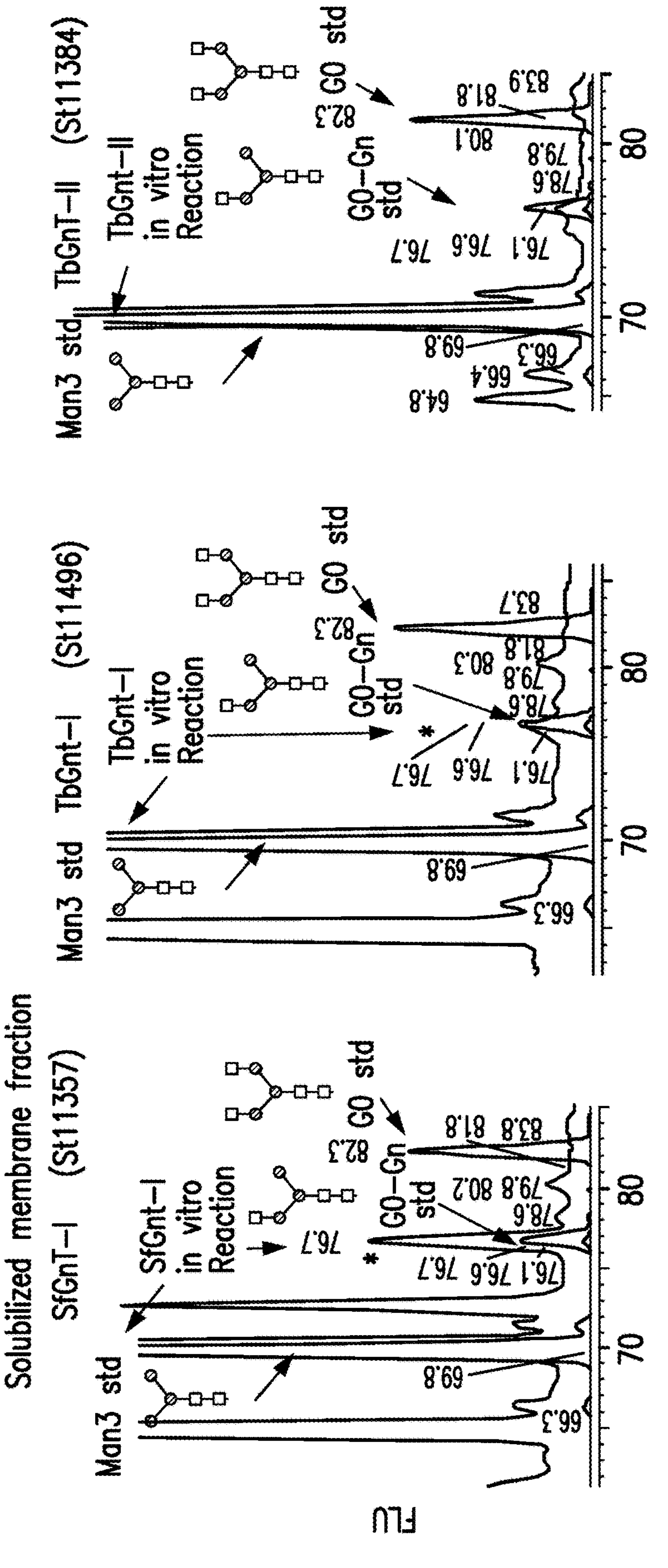

FIGS. 10A and 10B: HPLC separation of 2-AB labeled N-glycan reaction products after SfGnT-I, TbGnT-I, or TbGnT-II in vitro activity assays. Immune enriched (FIG. 10A) or solubilized fractions (FIG. 10B) from SfGnT-I, TbGnT-I, or TbGnT-II expressing recombinant *L. tarentolae* were used in an in vitro assay on free paucimannose (Man3) as substrate. Cleaned and 2AB labeled reaction products were separated on HPLC and compared to standards, Man3-2AB, G0-Gn (NGA3-N) and G0 (NGA2). Peaks at RT 76.7' indicate activity of the heterologous GnT-I enzymes, marked with an asterisk.

Figure 11A:
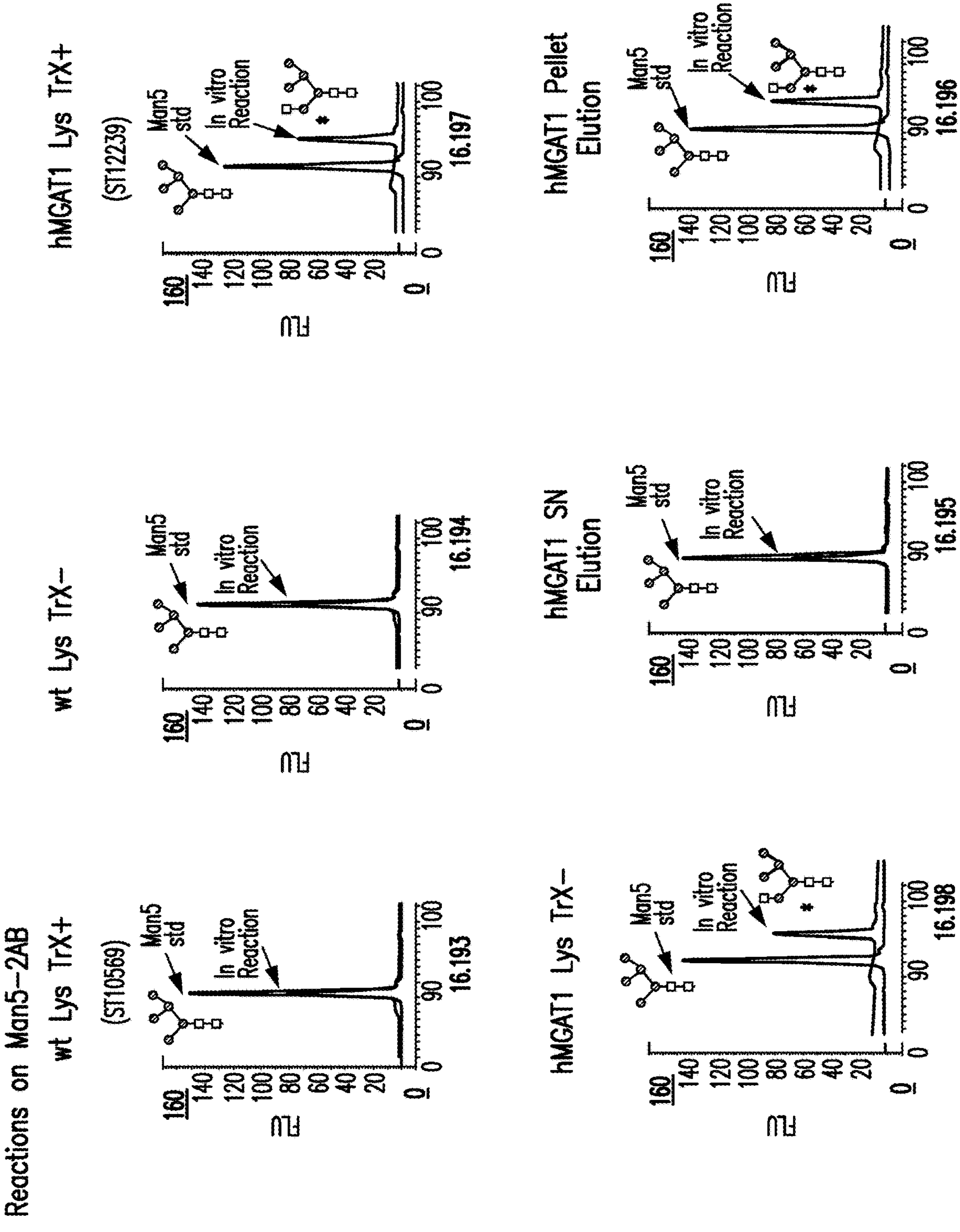
Figure 11B:
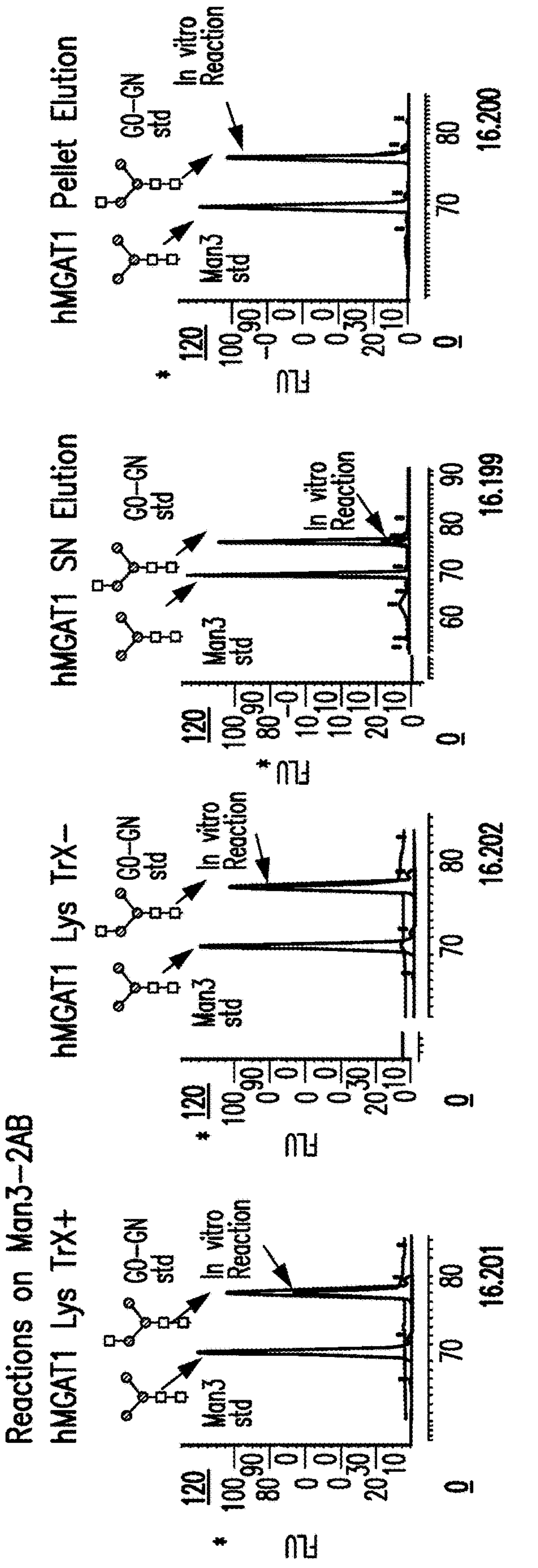

FIGS. 11A and 11B: HPLC separation of 2-AB labeled N-glycan reaction products after MGAT1 in vitro activity assays. Immune enriched MGAT1 from SN or pellet as well as solubilized fractions and lysates from MGAT1 expressing recombinant *L. tarentolae* were used in an in vitro assays: (FIG. 11A) on 2AB-labeled high mannose (Man5) the commonly used biosynthetic acceptor for MGAT1 in known N-glycosylation pathways or (FIG. 11B) on 2AB-paucimannose (Man3) as substrate mimicking the Man3 acceptor for elongation in the Golgi in *Leishmania* N-glycan pathway. As negative control, lysates from wt *L. tarentolae* cells were used in the reactions. Cleaned 2AB labeled reaction products were separated on HPLC and compared to standards, FIG. 11A) Man5 or FIG. 11B) Man3; G0-Gn (NGA2-N, green). Peaks marked with an asterisk indicate activity of the heterologous GnT-I enzymes.

Figure 12A:
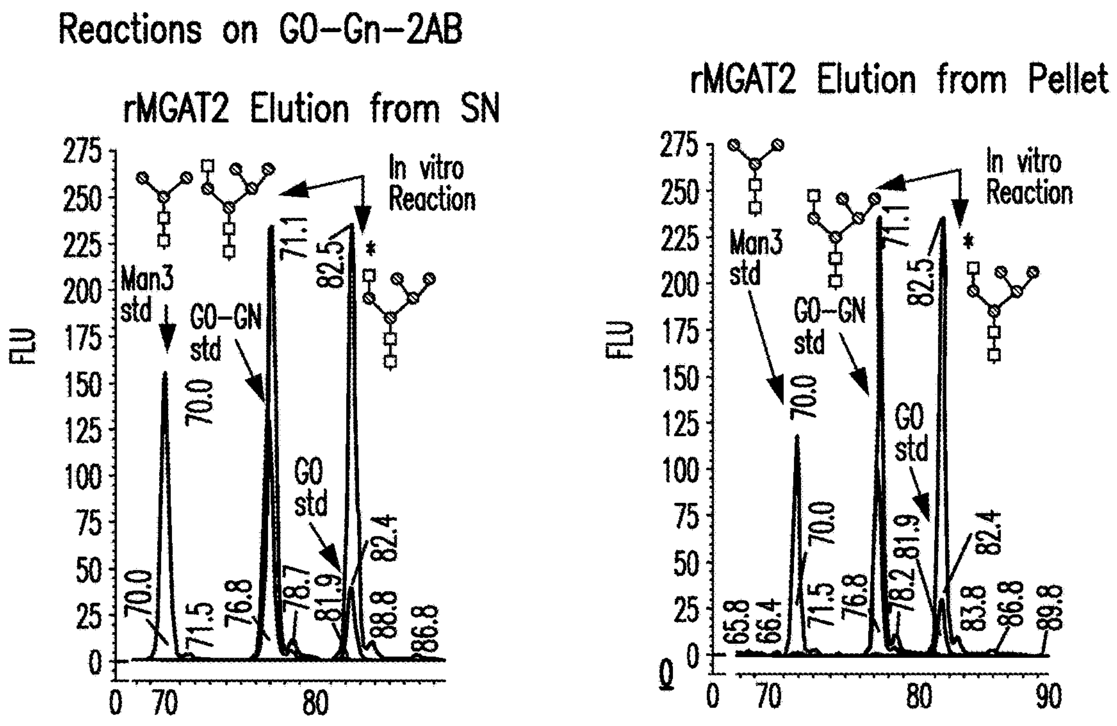
Figure 12B:
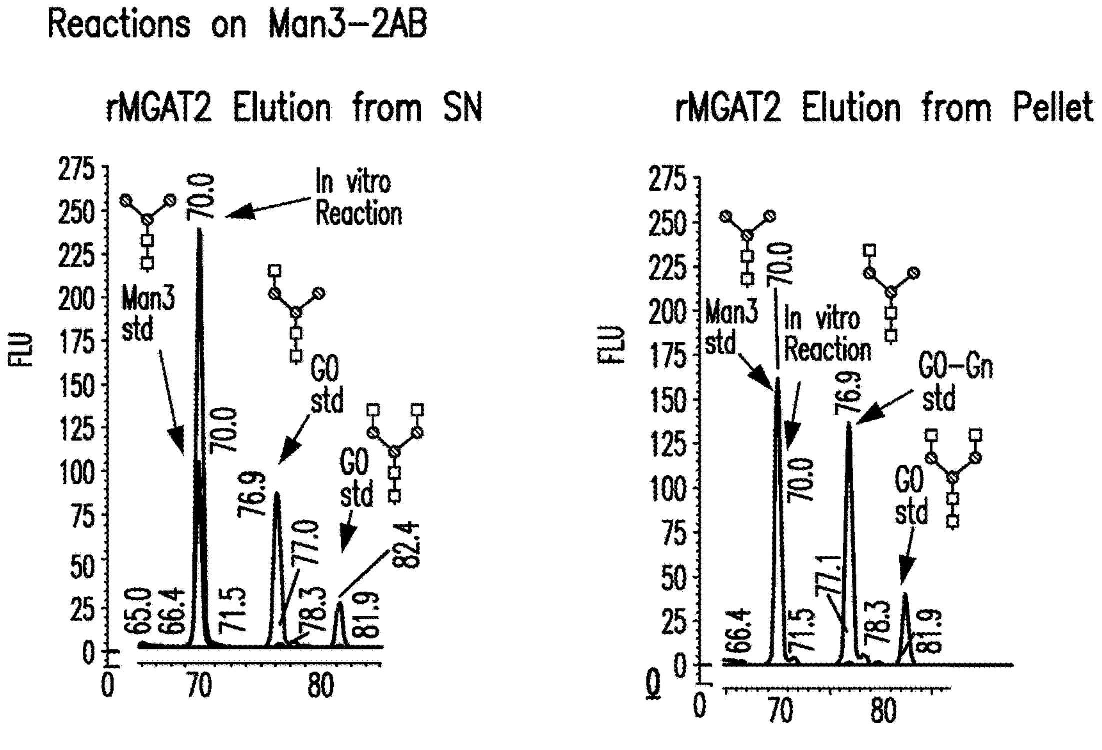

FIGS. 12A and 12B: HPLC separation of 2-AB labeled N-glycan reaction products after MGAT2 in vitro activity assays. Immune enriched MGAT2 from SN or pellet from recombinant *L. tarentolae* was used in an in vitro assay on 2AB-labeled G0-Gn (NGA2-N) the commonly used biosynthetic acceptor for MGAT2 in known N-glycosylation pathways (FIG. 12A) or on 2AB-paucimannose (Man3) as substrate mimicking the Man3 acceptor for elongation in the Golgi in *Leishmania* N-glycan pathway (FIG. 12B), which is not elongated by MGAT2. Cleaned 2AB labeled reaction products were separated on IPLC and compared to standards, Man3, G0-Gn (NGA2-N) and G0 (NGA2). Peaks marked with an asterisk indicate activity of the heterologous GnT-II enzyme.

Figure 13C:
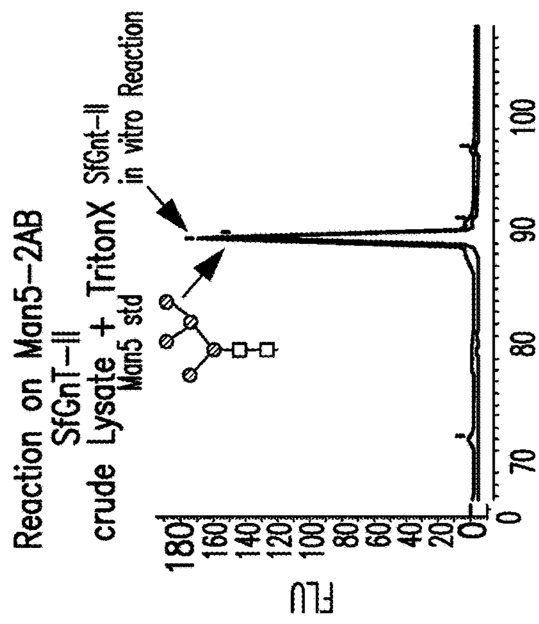
Figure 13B:
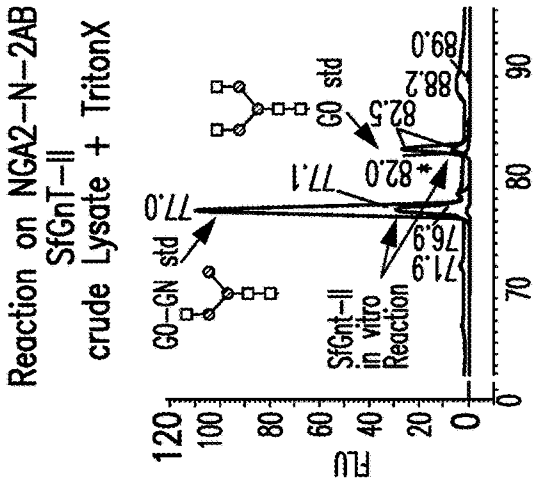
Figure 13A:
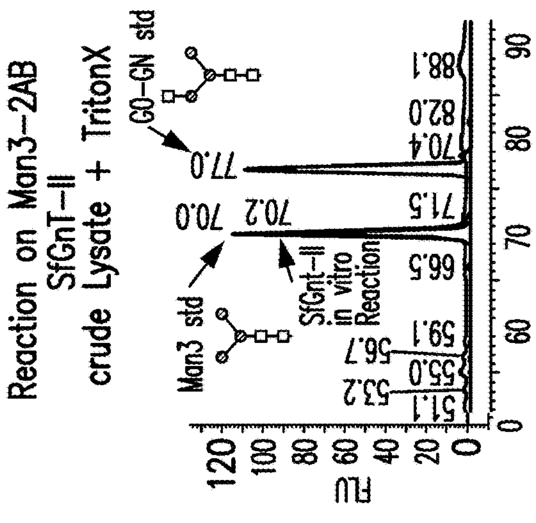

FIGS. 13A, 13B and 13C: HPLC separation of 2-AB labeled N-glycan reaction products after SfGnT-II in vitro activity assays. Crude lysates from SfGnT-II expressing recombinant *L. tarentolae* was used in an in vitro assay: on 2AB-paucimannose (Man3) as substrate mimicking the Man3 acceptor for elongation in the Golgi in *Leishmania* N-glycan pathway (FIG. 13A); on 2AB-labeled G0-Gn (NGA2-N) the commonly used biosynthetic acceptor for Gnt-II reactions in known N-glycosylation pathways (FIG. 13B) or on 2AB labeled Man5, not an substrate for GnT-II (FIG. 13C). Cleaned 2AB labeled reaction products were separated on HPLC and compared to standards, Man3, G0-Gn (NGA2-N) and Man5. Peaks marked with an asterisk indicate activity of the heterologous GnT-II enzyme.

Figure 14A:
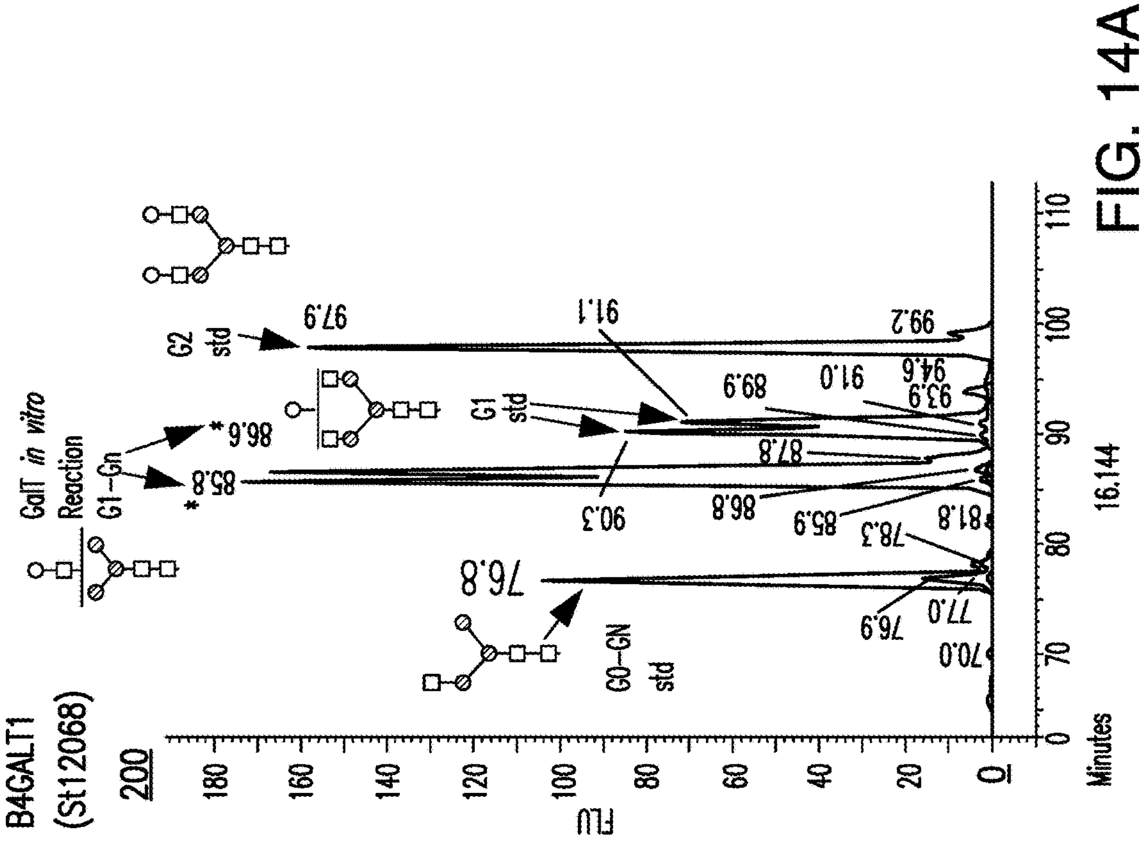
Figure 14B:
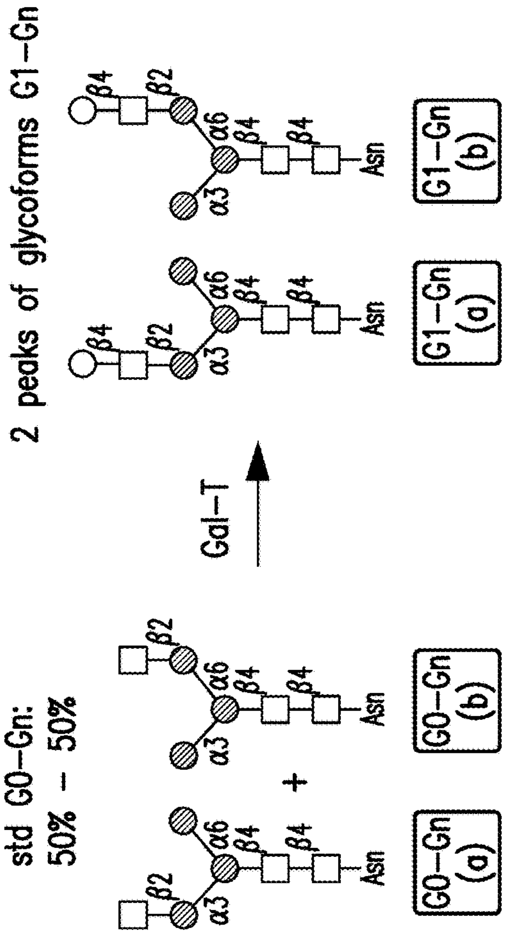
Figure 14C:
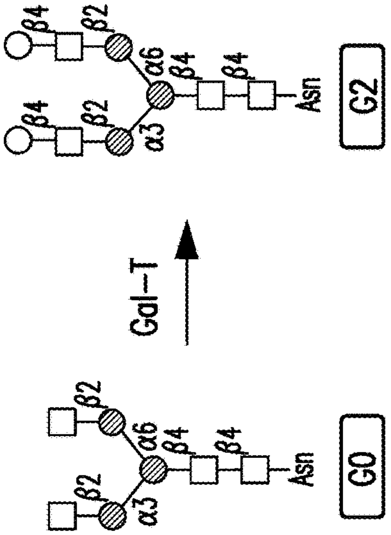

FIGS. 14A, 14B and 14C: HPLC separation of 2-AB labeled N-glycan reaction products after B4GALT1 in vitro activity assays. FIG. 14A: Immuno-enriched B4GALT1 from recombinant *L. tarentolae* was used in an in vitro assay on 2AB-G0-Gn (NGA2-N). Cleaned 2AB labeled reaction products were separated on HPLC and compared to standards, G0-Gn (NGA2-N) G1 (NA2G1), NA2 (G2) Peaks marked with a star indicate activity of the heterologous GalT enzyme. FIG. 14B shows schematic glycoforms representation of the composition of the commercial NGA2-N (G0-Gn) standard and the expected reaction outcome after the B4GALT1 in vitro assay showing G1-Gn forms on the two different branches. FIG. 14C represents the expected reaction product when using G0 (NGA2) as substrate for a GalT.

Figure 15:
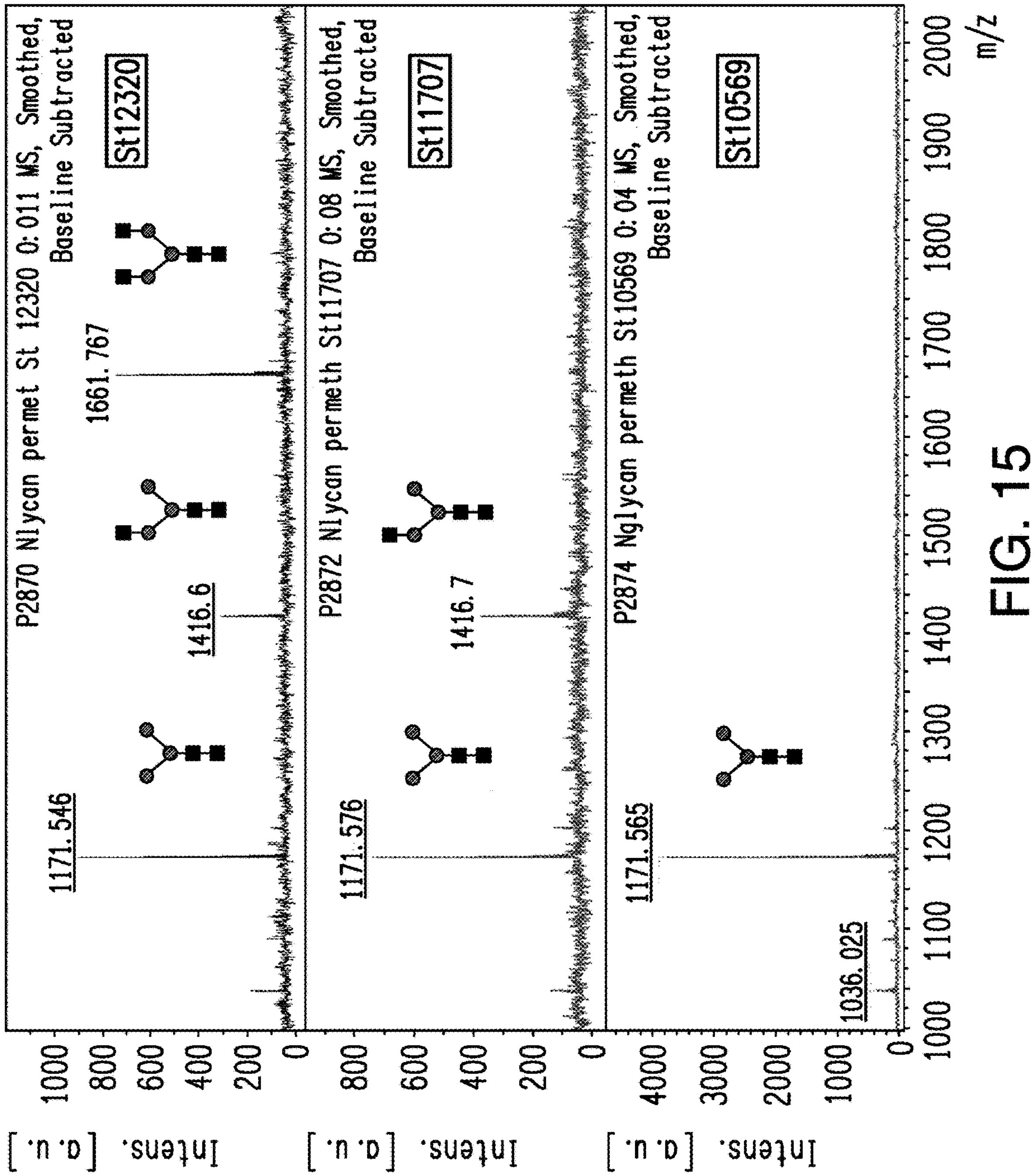

FIG. 15: MALDI-TOF MS spectra of range m/z 1000-2200 of the permethylated PNGase F released N-glycans of wt and glycoengineered *Leishmania tarentolae*. Glycoforms are annotated above the m/z peaks.

Figure 16:
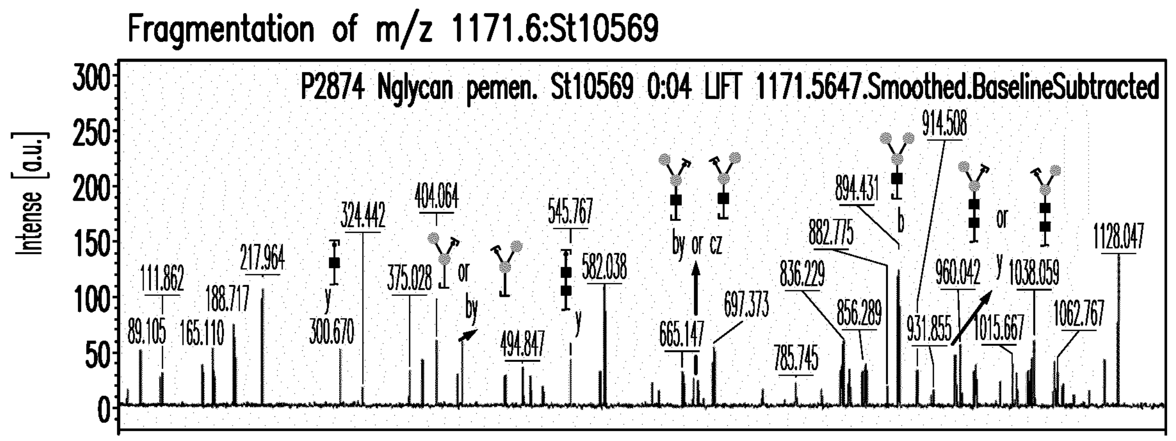
Figure 16:
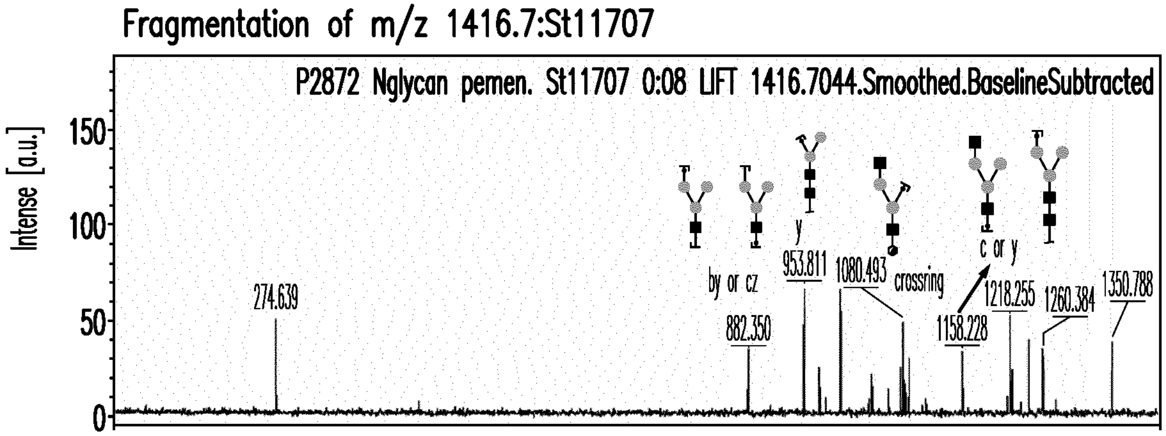
Figure 16:
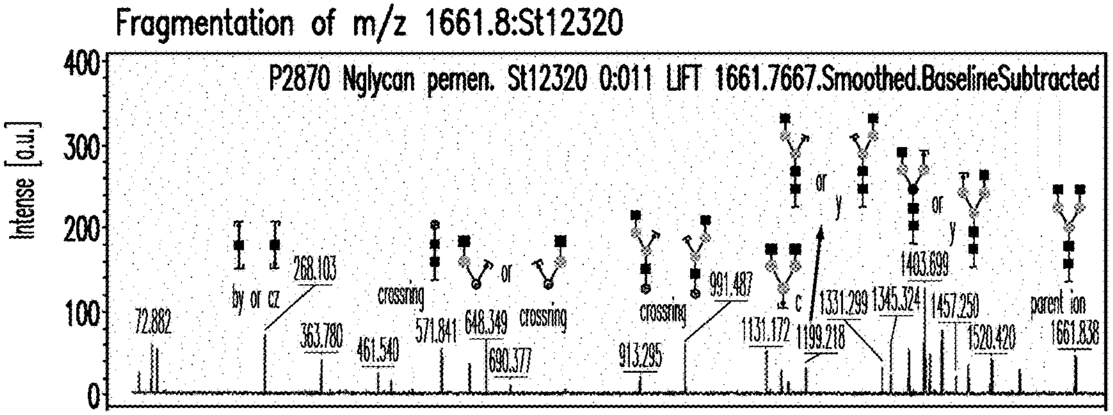

FIG. 16: MALDI-TOF/TOF MS fragmentation spectra of the identified glycoforms. Fragment ions present in the spectrum of m/z 1171.6 (=Man3) from the wt St10569 (top), of m/z 1416.7 (=G0-Gn) from spectrum of SfGnT-I expressing recombinant strain St11707 (middle), and of m/z 1661.8 (=G0) from spectrum of SfGnT-I and SfGnT-II co-expressing recombinant St12320 (bottom) confirm the permethylated N-glycans of Man3 (top), G0-Gn (middle) and G0 (bottom).

Figure 17A:
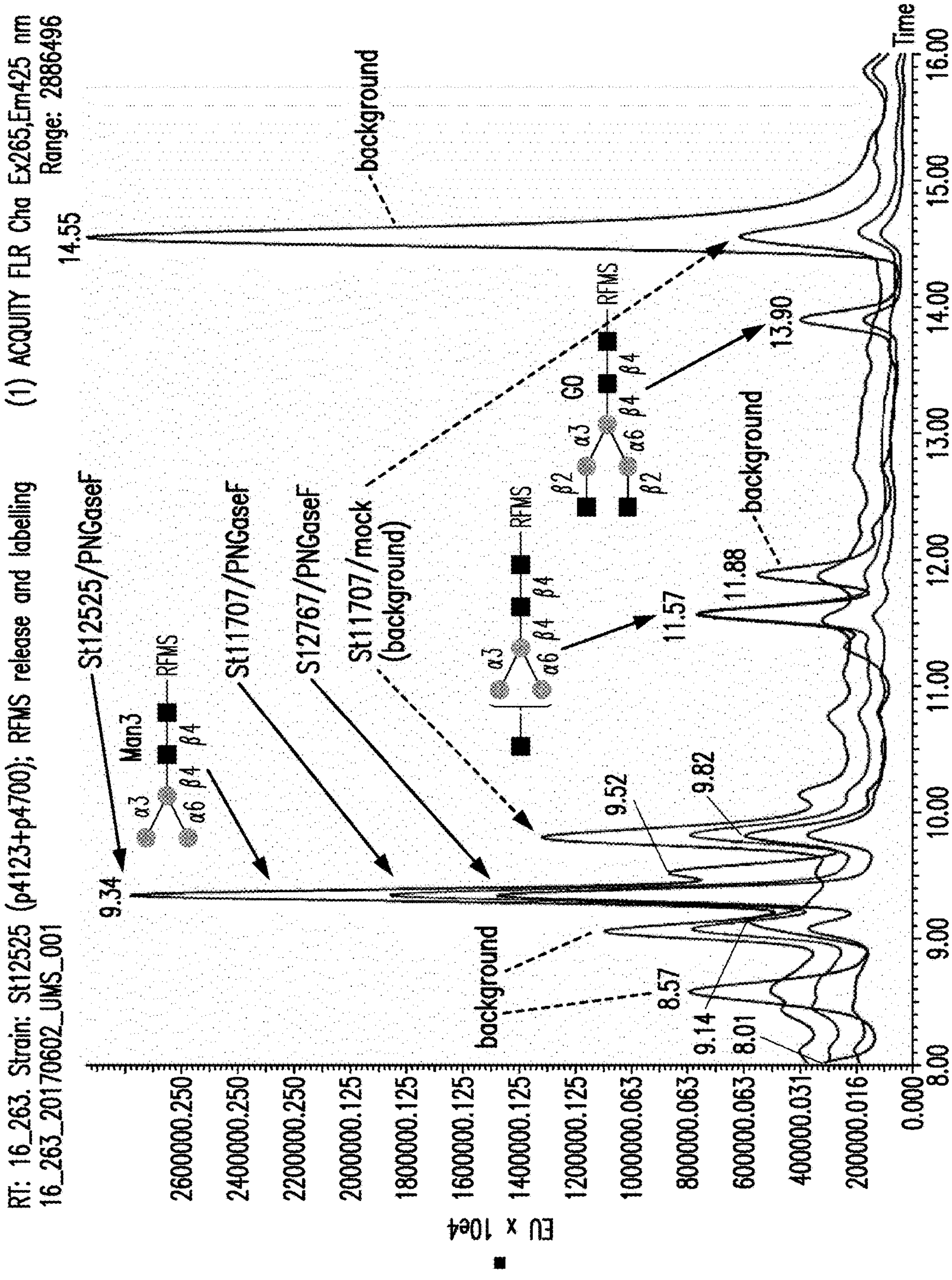
Figure 17B:
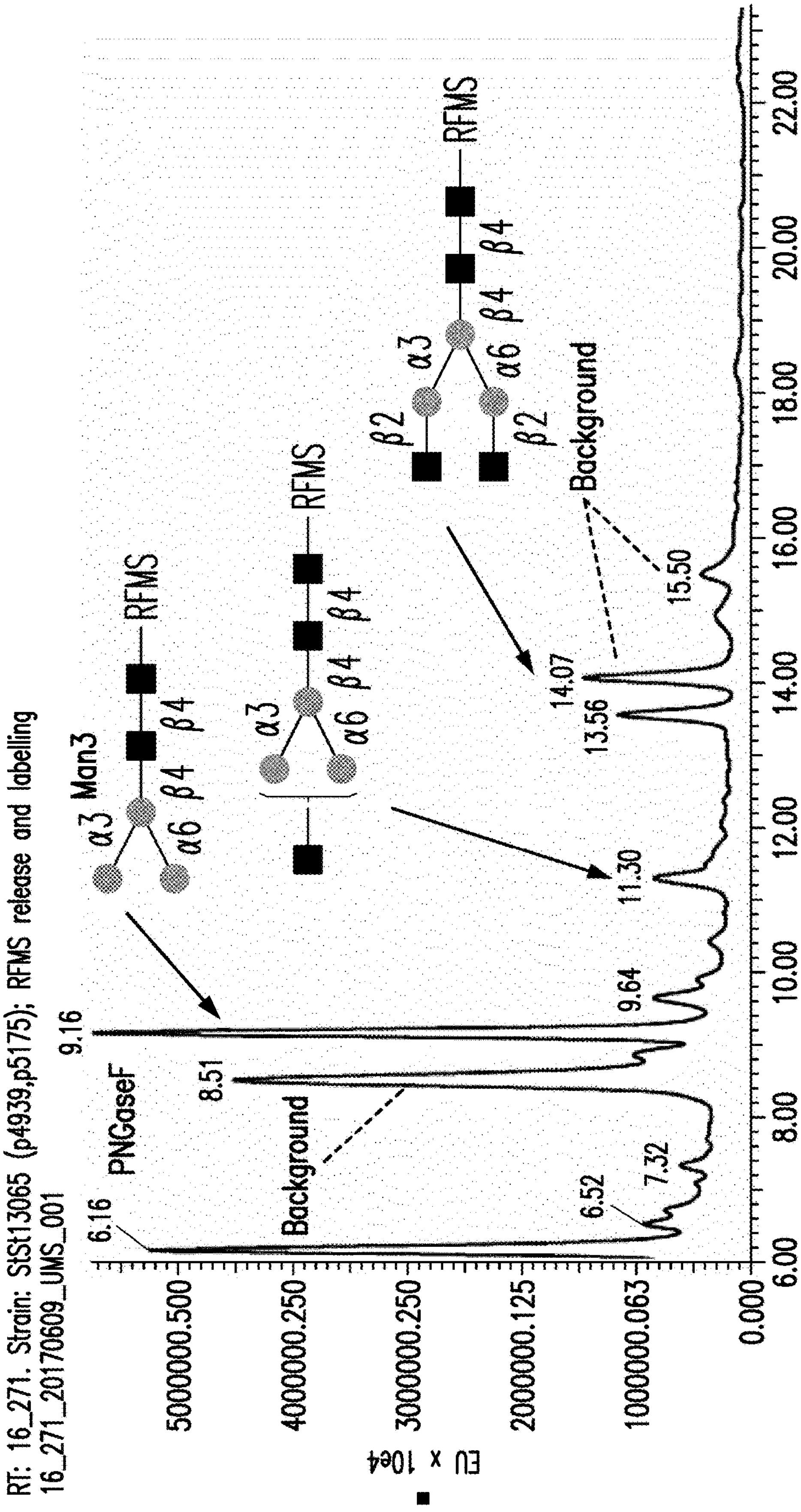
Figure 17C:
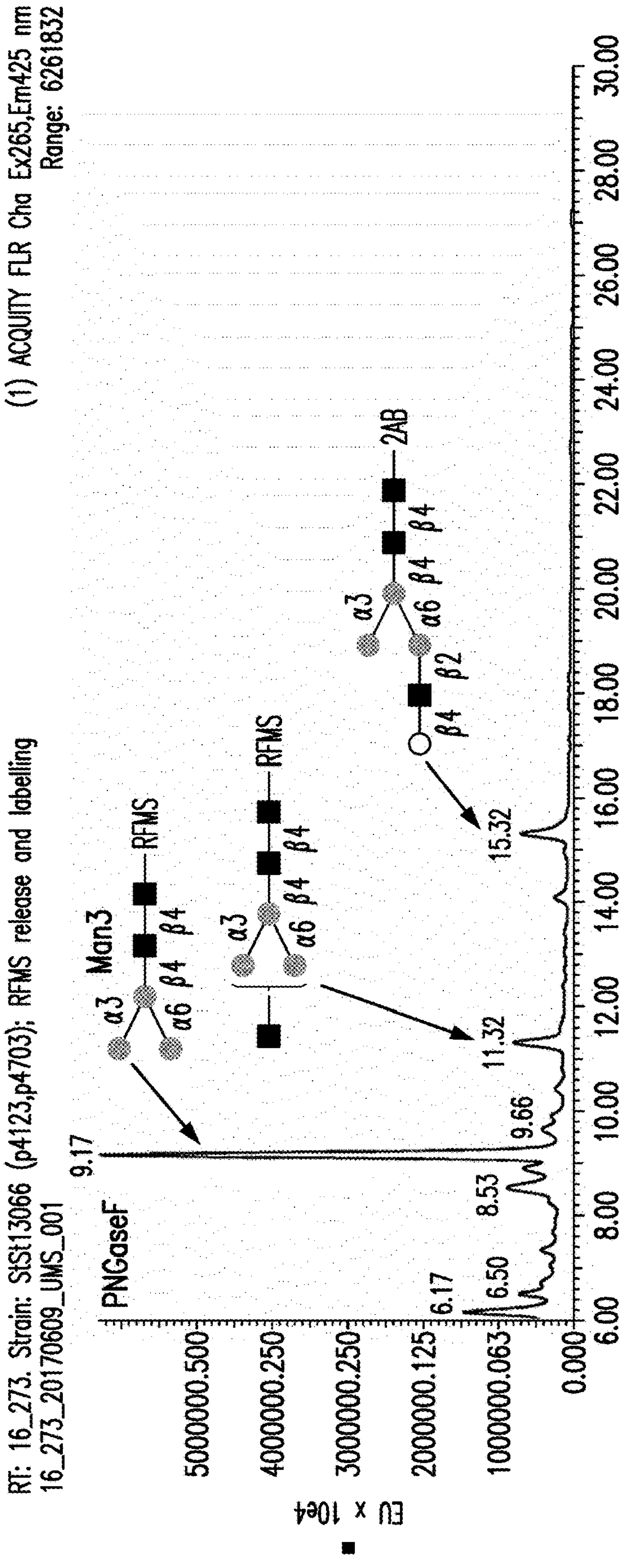

FIGS. 17A, 17B and 17C: UPLC separation and m/z determination by MS of PNGase F released and RF-labeled N-glycans or mock treated from recombinant glycoengineered *Leishmania tarentolae* cell pellets is shown in FIG. 17A, dashed lines represent the background peaks visible in the mock sample. RF-labeled N-glycans were derived from: 16.260—St 11707 (SfGnT-I) with PNGase F; 16.261—St 11707 (SfGnT-I)—Mock; 16.263—St12525 (SfGnT-I and SfGnT-II)—PNGase F, and 16.264—St12767 (SfGnT-I and MGAT2)—PNGase F and overlaid. M/z confirmed glycan peaks are indicated with bold arrows FIG. 17B shows N-glycans from St 13065 (MGAT1 and MGAT2) and FIG. 17C of St13066 (SfGnT-I and B4GalT1) m/z was confirmed in peaks annotated schematically above with [M+H] m/z=1222 Man3, m/z=1425 G0-Gn, m/z=1628 (G0) and m/z=1587 (G1-Gn). Unlabeled peaks are also found in mock digests and contain putative cell wall glycolipid fragments (dashed arrows, "background").

Figure 18:
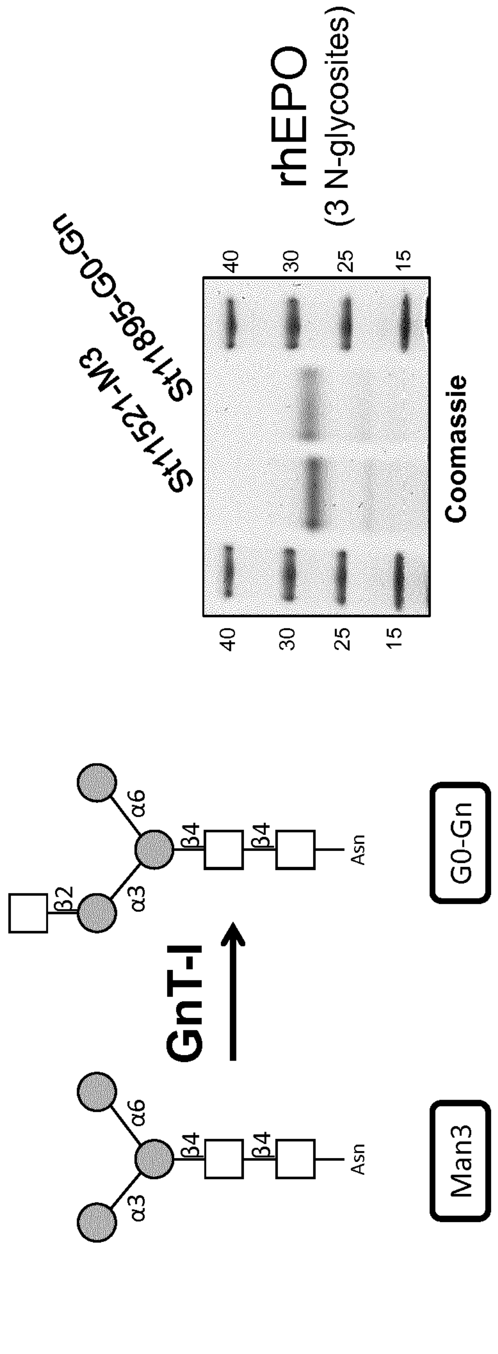

FIG. 18: N-glycan elongation for recombinant hEPO expressed in a glycoengineered *Leishmania*. GnT-I candidate SfGnT-I was recombinantly expressed to elongate the native N-glycan to G0-Gn. The recombinant target protein human erythropoietin (rhEPO) was expressed alone (St11521) or co-expressed with SfGnT-I (St11895). rhEPO was secreted by *Leishmania* secretory pathway and purified from the culture supernatant. Coomassie SDS PAGE of two purified EPO samples. The molecular weight changes upon addition of the GlcNAc elongation to higher molecular weight.

FIG. 19: rhEPO site occupancy by peptide mapping. Light gray: EPO peptides in the flow through fraction of the glycopeptide enrichment step. Gray: peptide present in the flow through fraction and in the enriched glycopeptide fraction. Dark gray: EPO peptide covering N-glycosylation sites N24 and N38 found in its deamidated form in the enriched glycopeptide fraction after deglycosylation with PNGase A+F. This peptide was not detected in its non-glycosylated form. The peptide harboring N-glycosylation site N83 was not clearly detected (neither in its non-glycosylated, nor in its deglycosylated forms) in this study. N-glycosylation sites indicated in bold. SEQ ID NO: 108 is depicted.

FIG. 20: Glycopeptides of rhEPO with identified N-glycans. N-glycosylation N24 and N38 sites are indicated. SEQ ID NO: 109 is depicted.

Figure 21A:
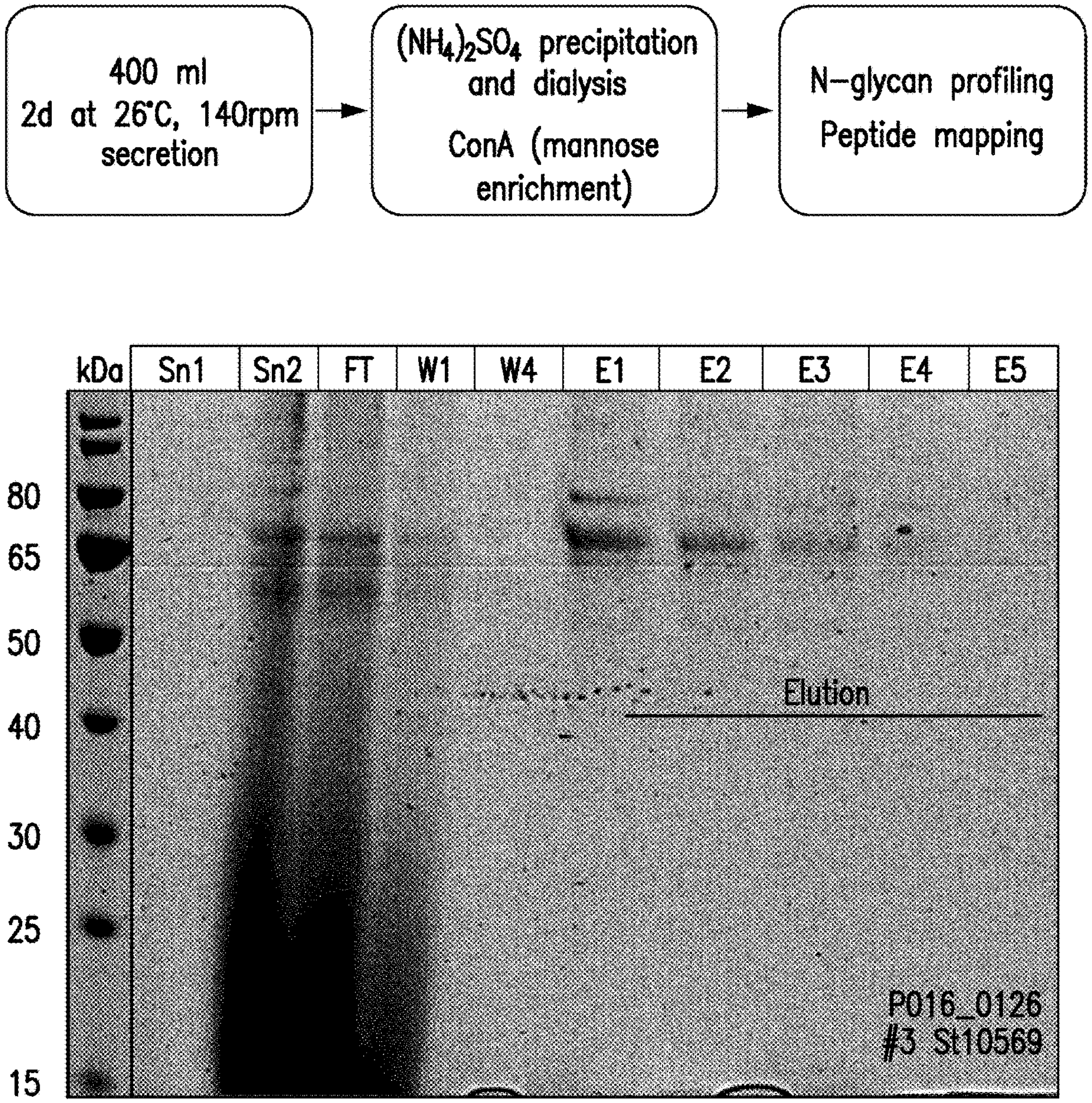

FIGS. 21A and 21B: Identification of native secreted glycoproteins. FIG. 21A) summarizes the workflow in boxes and Coomassie SDS PAGE shows Elution profiles (E1 to E5) after ConA enrichment. Predominant proteins ran between 60 and 80 kDa. Elutions were used for N-glycan release and 2AB labeling and proteins were identified using a proteomic approach using peptide mapping. FIG. 21B: Identified proteins are shown with the number of peptides identified with sequence coverage indicating a probability of >96%.

Figure 22A:
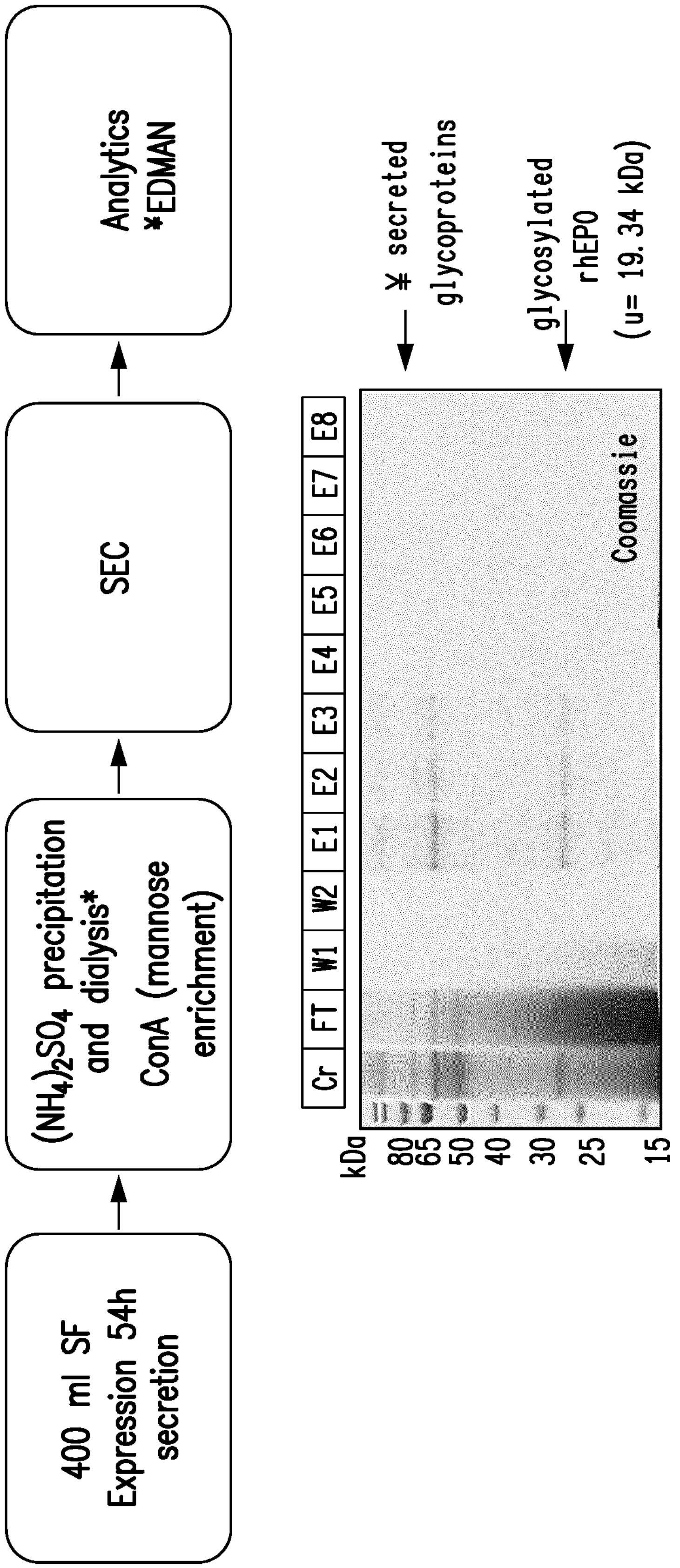

FIGS. 22A and 22B: Identification of processed N-terminus of native secreted glycoprotein Invertase. FIG. 22A: The workflow is summarized in boxes. Supernatant of St10881 was (NH4)2SO4 precipitated and purified using ConA. ConA Elutions E1 to E8 are shown in the Coomassie SDS PAGE. After size exclusion, the most prominent secreted protein other than rhEPO was collected and subjected to EDMAN N-terminal sequencing. FIG. 22B shows the sequence of invertase that was identified by peptide mapping, with light gray marks of the peptides found. The circle indicates the processed N-terminus from the EDMAN N-terminal sequencing DGVPYEx (SEQ ID NO: 157). SEQ ID NO: 110 is depicted.

Figure 23:
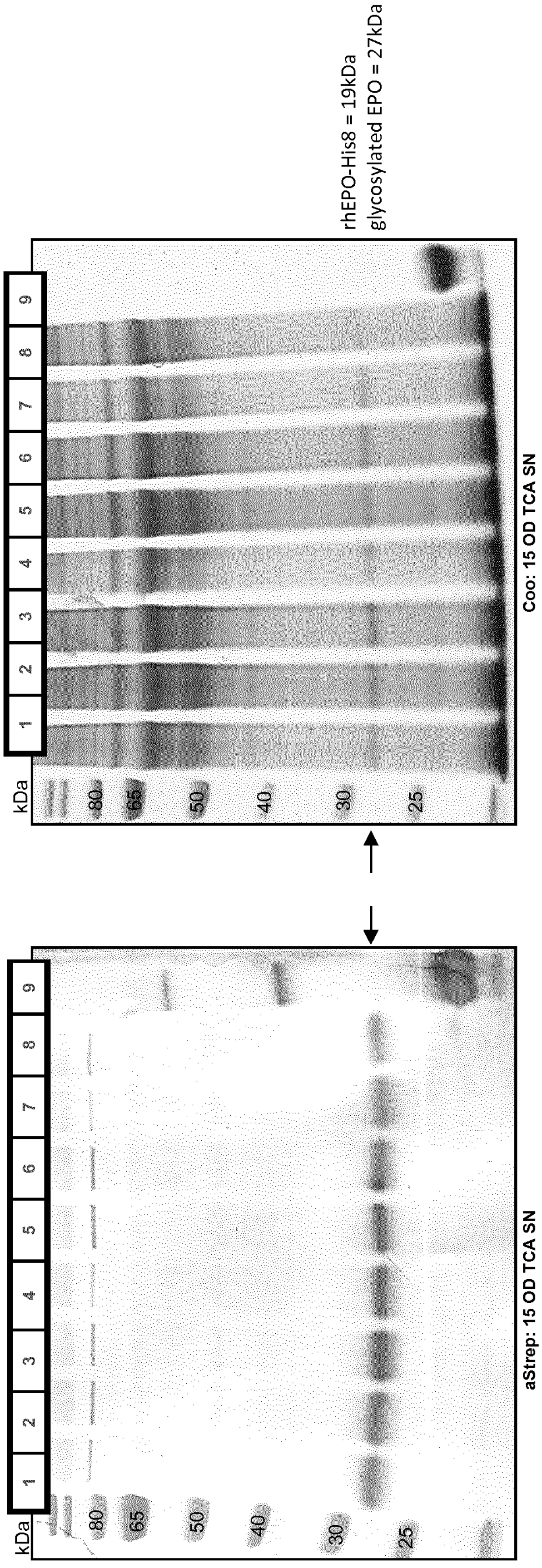

FIG. 23: rhEPO was secreted when genetially fused to the invertase secretion sequence from invertase. EPO was expressed with two different signal peptides for secretory translocation to secretion into the supernatant. TCA precipitated supernatant was loaded corresponding to 15 ODs of cells on SDS PAGE either immune-blotted (left) or coomassie stained (right). Both rhEPO variants, either with the LMSAP secretion signal (St11376) or from the invertase (St11377), each with 5 different monoclones, were found in the SN running at a molecular weight indicating their N-glycosylated forms.

Figure 24A:
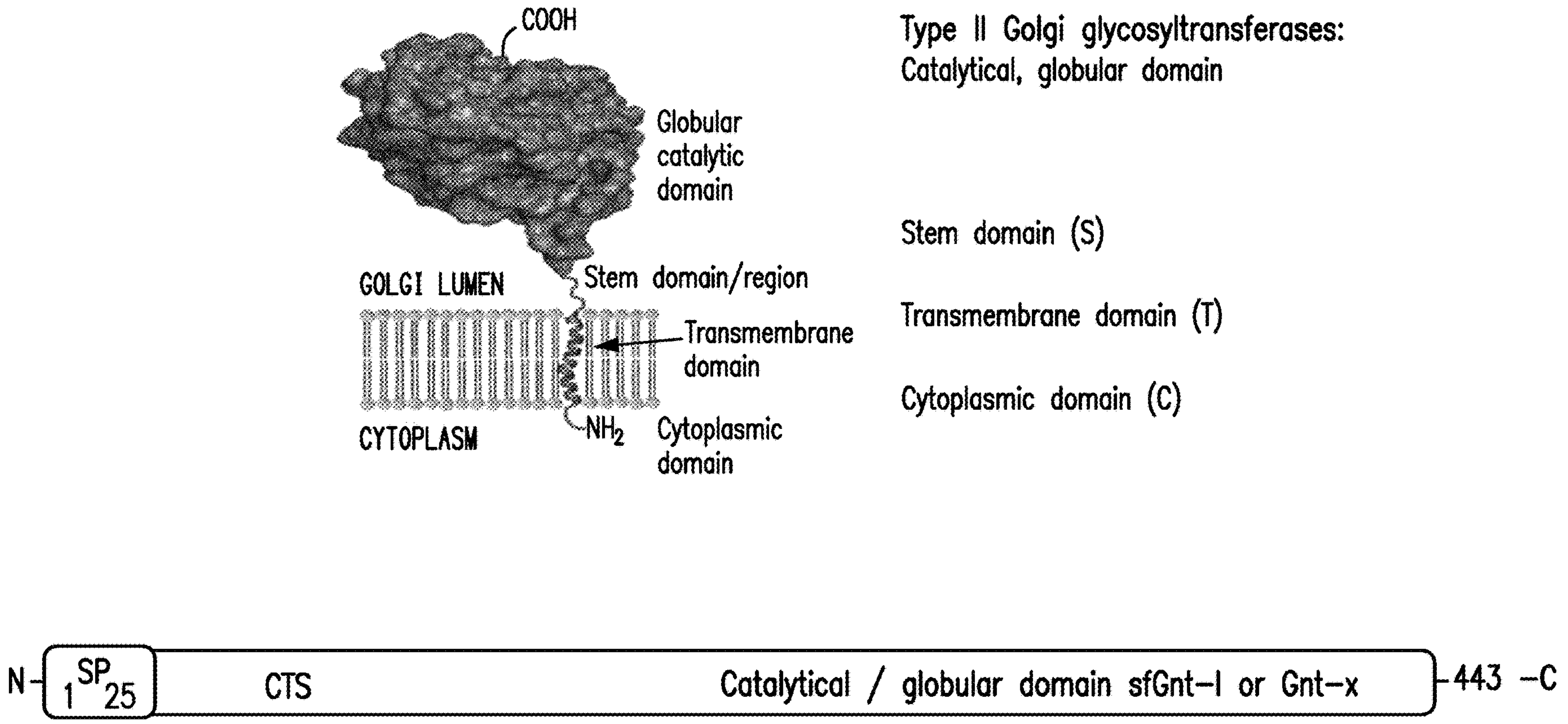

FIGS. 24A and 24B: Domain predictions of native Golgi localized proteins. Most of the Golgi localized glycosyltransferases are type II membrane proteins with a short N-terminal cytoplasmic domain, an approximately 20 amino acid a-helical TM-domain, a stem domain and a C-terminal globular catalytic domain in the lumen of the secretory pathway. (Kellokumpu et al. 2016) FIG. 24A. Shown is the representative of a Gnt (Gnt-x) or SfGnT-I with the Secretion signal, and CTS at the N-terminus followed by the globular/catalytic domain. FIG. 24B shows the native and presumed Golgi Proteins MAN1, LtaNTPDase1 and 2 from *L. tarentolae* that were identified by bioinformatic comparisons and are listed with the amino acid sequence of the predicted CTS domains below the schematic bars. The GRIP domain was identified in LTAR_110005600.1 (previous naming scheme: LtaP11.0070) and this C terminal amino acid sequence is shown below the bar. SEQ ID NOS: 24-27 are depicted.

Figure 25:
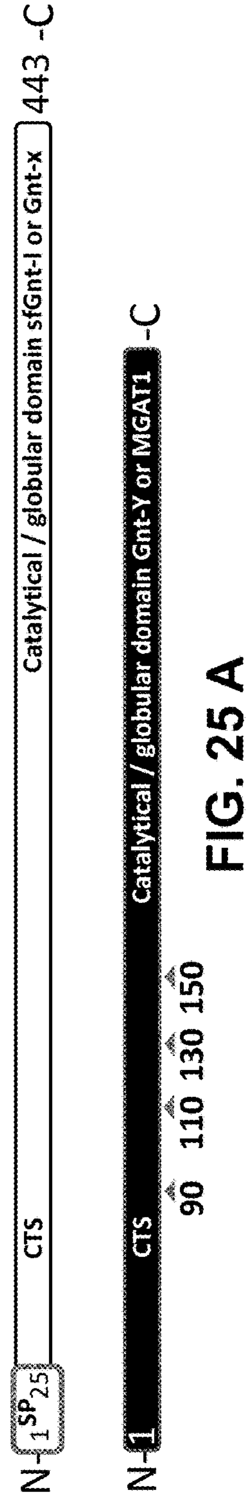
Figure 25B:
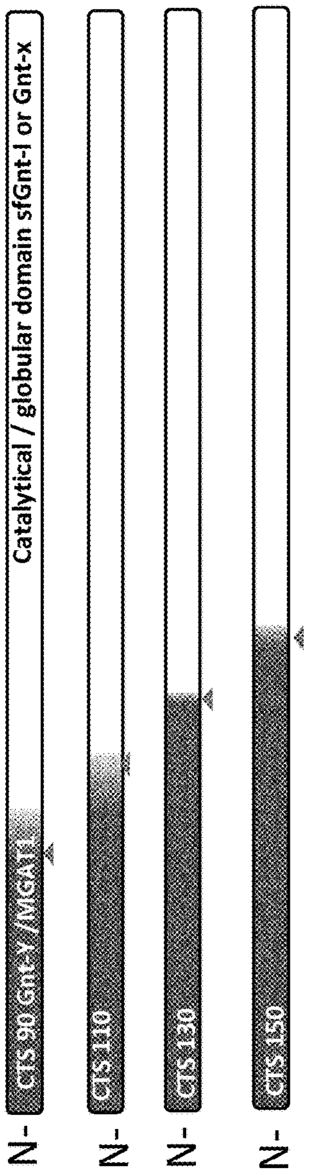
Figure 25C:
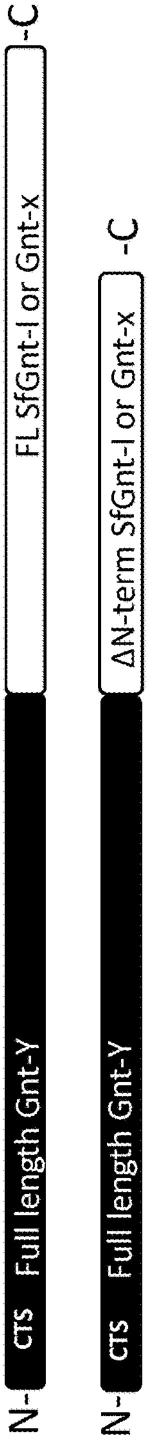

FIGS. 25A, 25B and 25C: Domain predictions of Gnts and hybrid design for improved Golgi targeting, retaining and homo or heterodimerization. Gnt-X is represented as white bar that is Sf-Gnt-I as shown example. In dark grey is the Gnt-Y, in the shown example MGAT1. Numbers below indicate the fusion points for the hybrid design after the CTS of Gnt-y/MGAT1. FIG. 25B shows 90, 110, 130 or 150 amino acids from the N-terminus of Gnt-Y/MGAT1 genetically fused as nucleotide sequence to the nucleotides of N-terminally truncated (Δ90, Δ110, Δ130 Δ150 amino acids) of Gnt-X/SfGnT-I. The full length (FL) Gnt-Y (MGAT1) is fused to the FL of Gnt-X/SfGnT-I (top) or the N-terminally CTS truncated Gnt-X/SfGnT-I (bottom) represented in FIG. 25C.

Figure 26A:
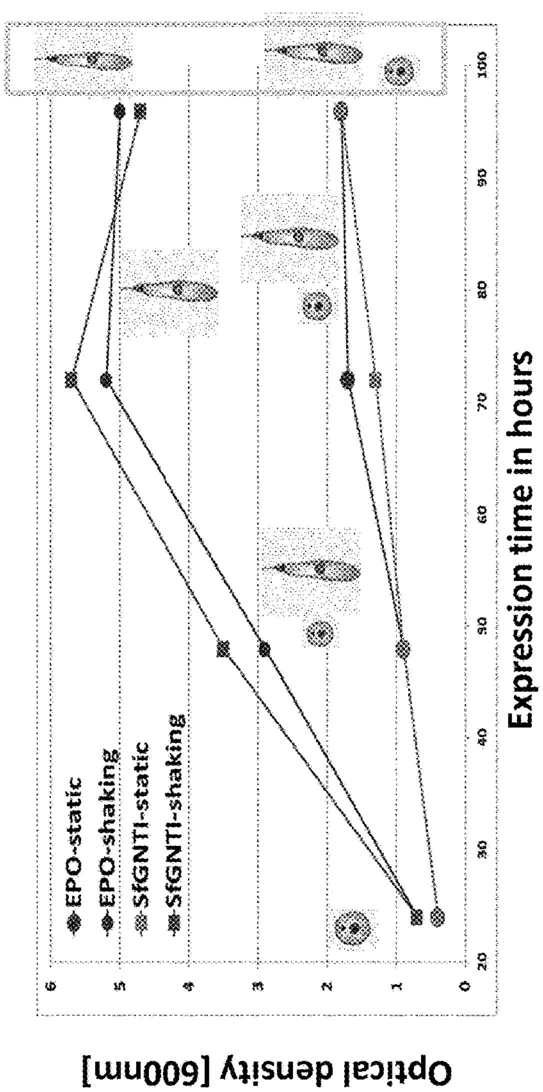
Figure 26B:
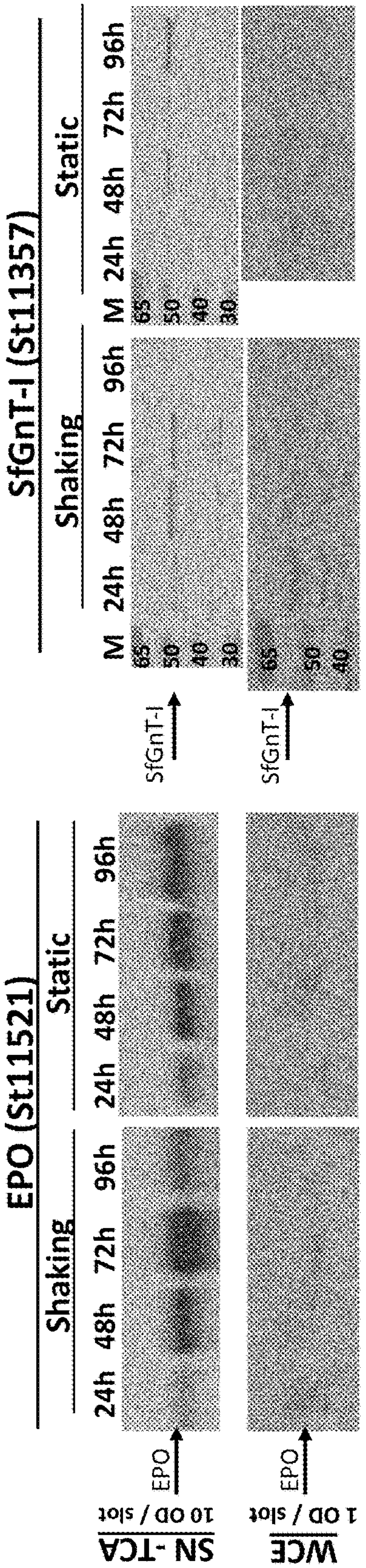

FIGS. 26A and 26B: Growth behavior of rhEPO or SfGnT-I recombinant cells and expression and localization of rhEPO or SfGnT-I over time Growth was monitored in static versus shaking cultures of cells expressing rhEPO (St11357) or SfGnT-I (St11521)—growth (OD) and shape is indicated in graph over time as shown in FIG. 26A. The expression rate of rhEPO or SfGnT-I over time and their localization was determined in TCA precipitated supernatants (SN) and whole cell extracts (WCE) by immune blot using an anti-Strep antibody (FIG. 26B).

Figure 27B:
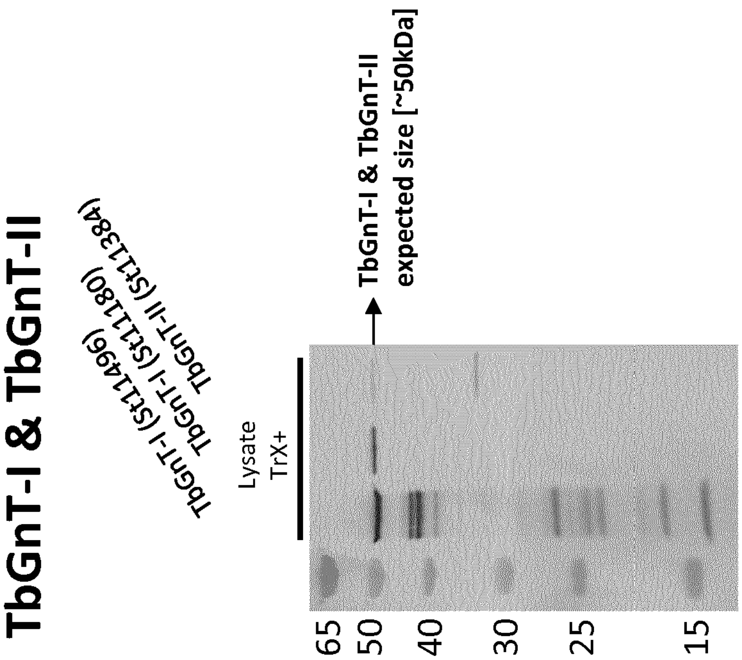
Figure 27A:
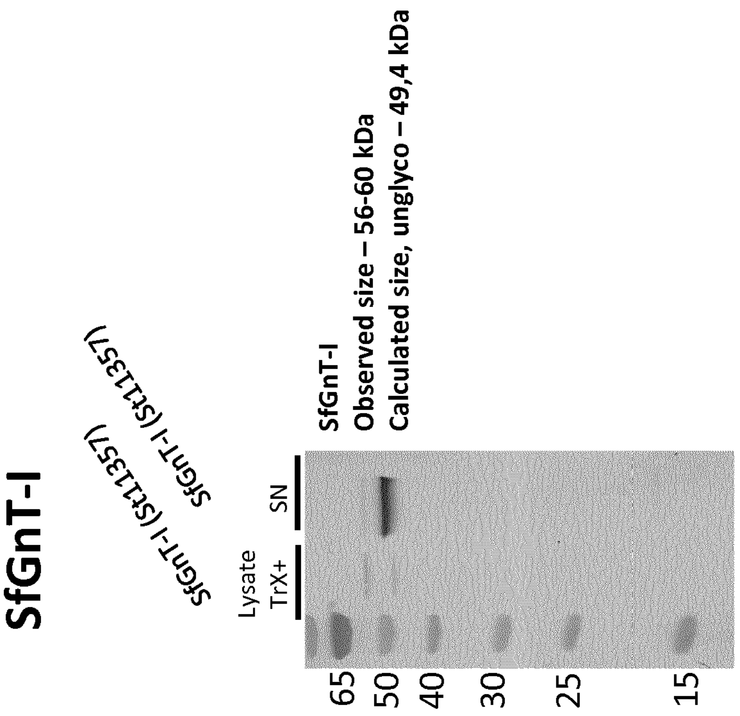

FIGS. 27A and 27B: Localization of SfGnT-I, TbGnT-I and TbGnT-II. Immunoblot detecting Strep tagged Sf-GnT-I, that was either TCA precipitated from culture SN with a load corresponding to 15ODs or affinity enriched with Streptavidin from cell lysates solubilized with TritonX (FIG. 27A). The *Trypanosoma* derived and HA-tagged TbGnT-I and TbGnT-II were detected by immunoblot in crude and Triton-X solubilized fractions (FIG. 27B).

Figure 28A:
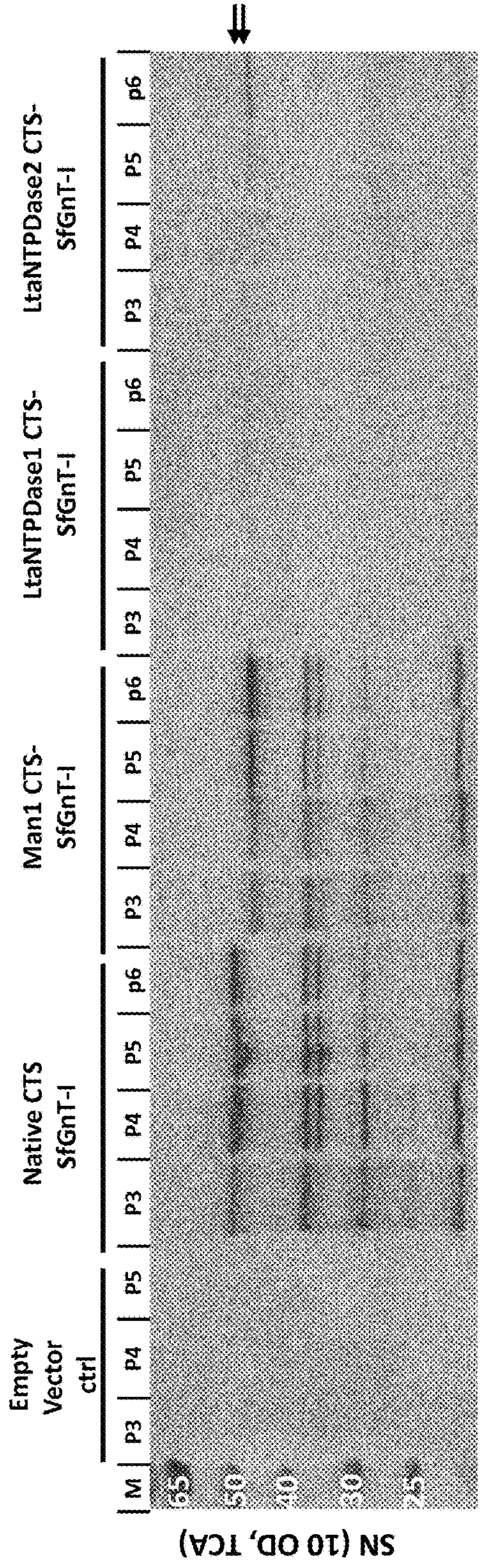
Figure 28B:
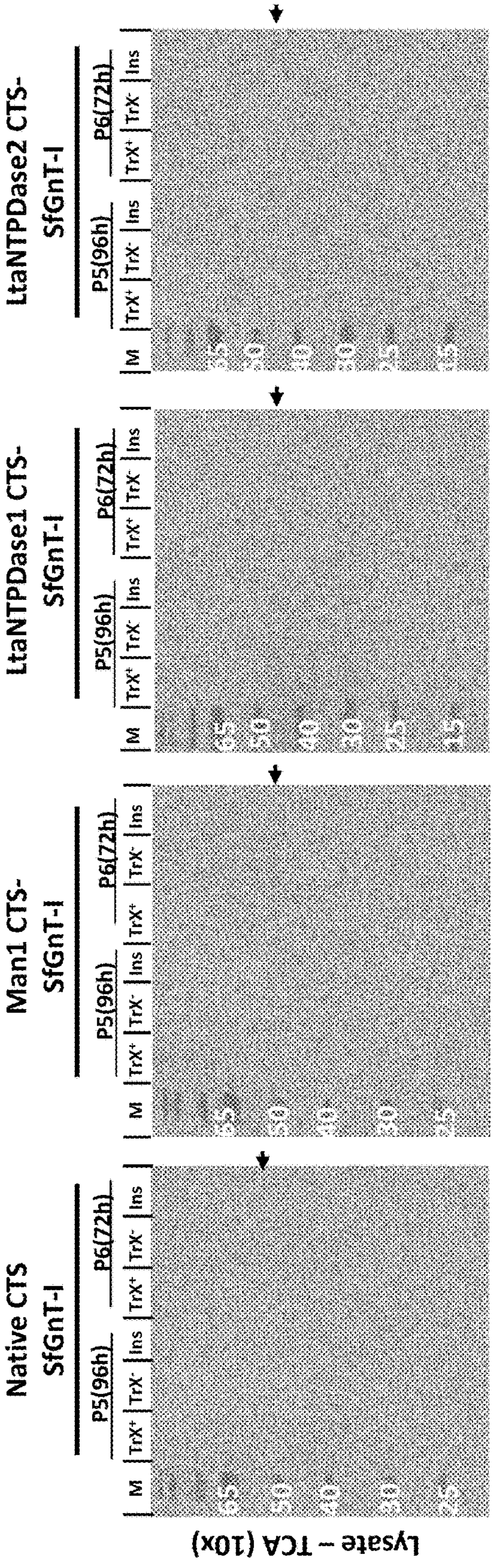

FIGS. 28A and 28B: Localization of hybrid Gnt variants of SfGnT-I. Native SfGnT-I or Man1-CTS or LTaNTPDase1 or 2 CTS hybrids of SfGnT-I were expressed and precipitated from culture SN (FIG. 28A), or from crude lysates with triton (TrX+) or without triton (TrX−) or homogenized from the insoluble part (Ins) (FIG. 28B).

Figure 29:
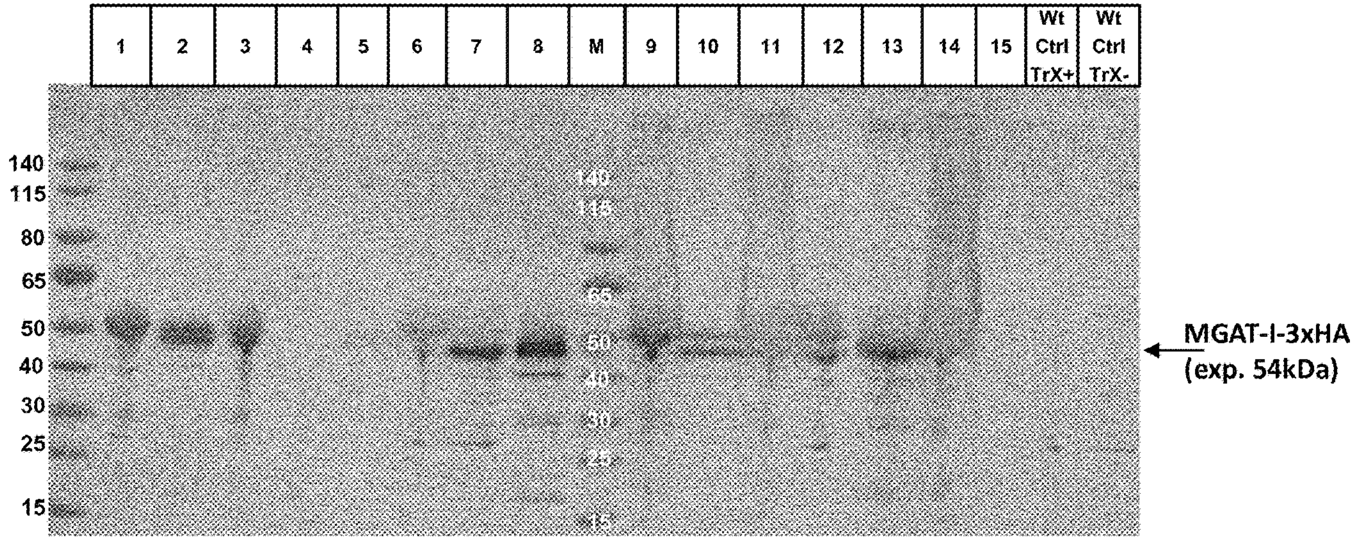

FIG. 29: Localization and affinity-enrichment of MGAT1. HA-tagged MGAT1 was detected by immunoblot from purification (Purif.) from affinity enriched fractions from either recombinant cell culture SN or from the pellets. Elu are elutions used for in vitro assays. For localization, MGAT1 was detected in lysates with triton (TrX+) or without triton (TrX−) or homogenized from the insoluble part (Insol. fr.) or from the debris.

Figure 30:
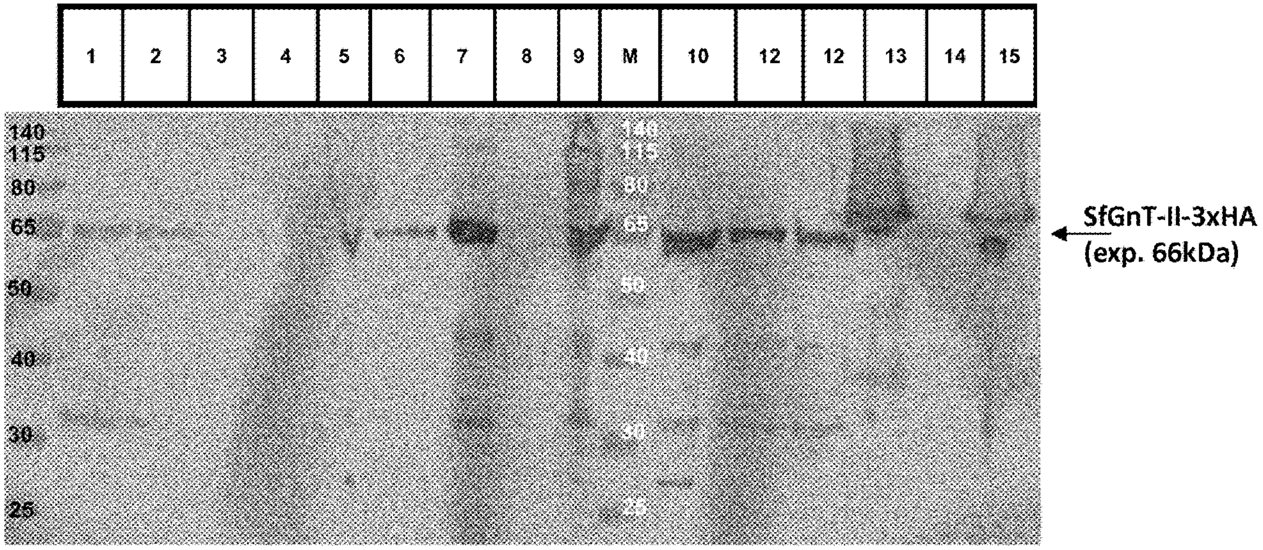

FIG. 30: Localization and affinity-enrichment of SfGnT-II. HA-tagged SfGnT-II was detected by immunoblot from purification (Purif.) from affinity enriched fractions from either recombinant cell culture SN or from the pellets. Elu are elutions used for in vitro assays. For localization, SfGnT-II was detected in lysates with triton (TrX+) or without triton (TrX−) or homogenized from the insoluble part (Insol. fr.) or from the debris.

Figure 31A:
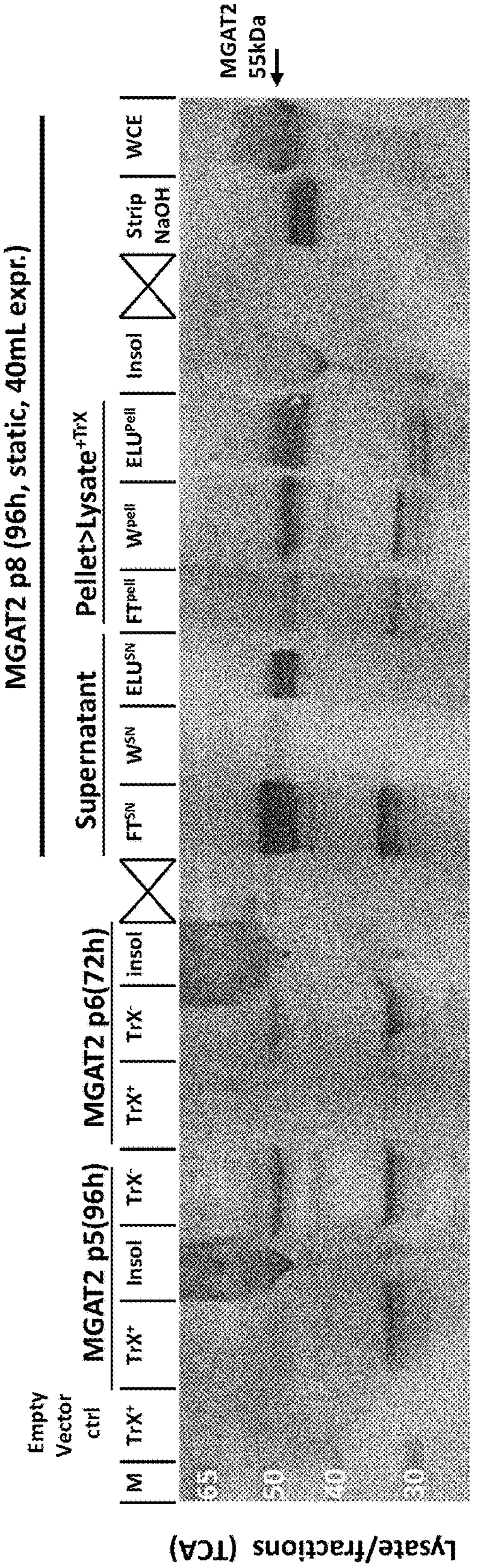
Figure 31B:
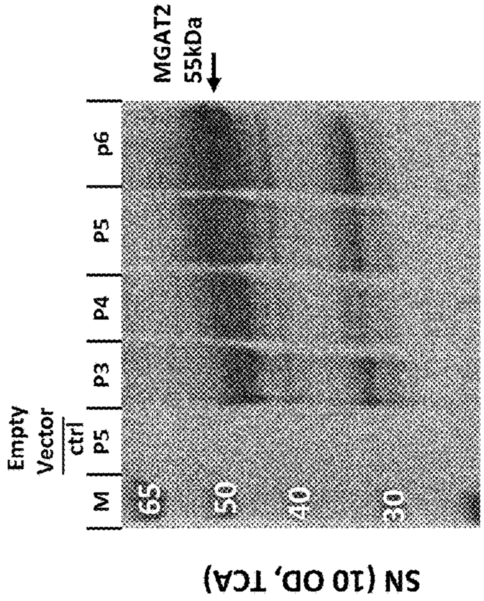

FIGS. 31A and 31B: Localization and affinity-enrichment of MGAT2. HA-tagged MGAT2 was detected by immunoblot from purification (Purif) from affinity enriched fractions (W, wash; Elu, elution) from either recombinant cell culture SN or from the pellets (Pell). Cells were grown either for 96 h or for 72 h. Elu are elutions used for in vitro assays. For localization, SfGnT-II was detected in lysates with triton (TrX+) or without triton (TrX−) or homogenized from the insoluble part (Insol. fr.) or from the debris (FIG. 31A). Localization and expression levels of MGAT2 in the precipitated cell culture SN over different passages is shown by anti-HA immunoblot (FIG. 31B).

Figure 32:
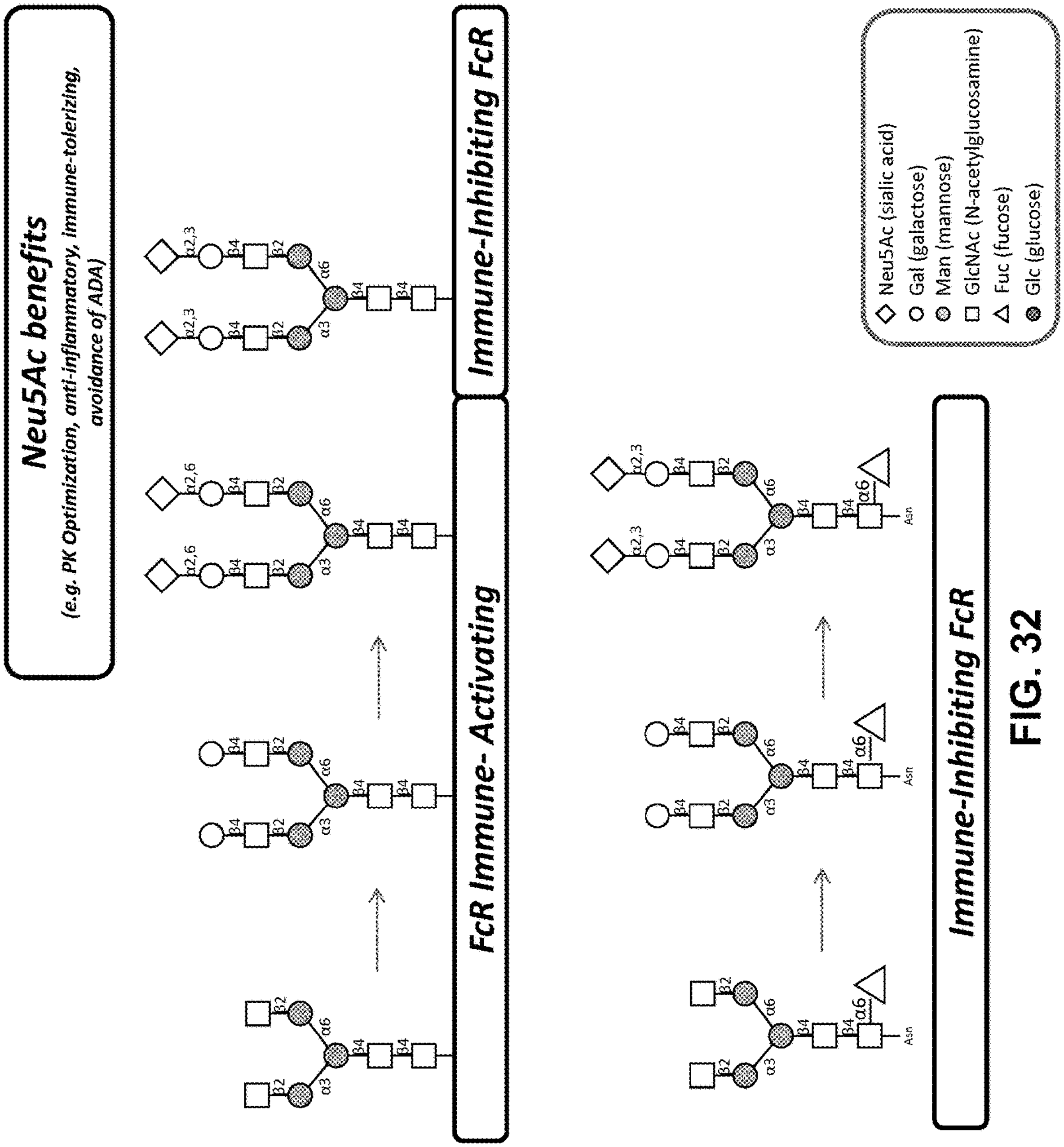

FIG. 32: Customized Fc glycans mediate desired downstream effector functions. Immune-activating glycans mediate effects like ADCC, ADCP and CDC. The indicated glycans on top are customized using the glycoengineered *Leishmania* platform for Fc molecules or antibody expression, for mediating immune activation, immune inhibition and/or PK optimization. If the biantennary glycan is terminated with α2,6 linked Neu5Ac, the function will be activating, but if it terminates with α2,3 linked Neu5Ac, the function will be immune-inhibiting. Supporting evidence is discussed in (Chen et al. 2017; Li et al. 2017). If biantennary N-glycans are terminated by sialic acid independent on their specific linkage, the PK will be improved, by increasing circulatory half-life due to the presence of sialic acids. Moreover, immune-tolerizing benefits of α2,6 linked Neu5Ac are anticipated to avoid generation of anti-drug antibodies (ADA) of potentially immunogenic therapeutics. Immune inhibiting glycans at the bottom are the core α1,6 fucosylated glycans, the typical glycan derivatives (without terminal sialic acids) from CHO cell platforms.

FIG. 33: Amino acid sequence of recombinant Rituximab, an anti-CD20 monoclonal antibody. The protein sequence of light chain (LC) and heavy chain (HC) with the modified invertase secretion sequence is shown in bold and the Fc N-glycosylation site in bold and underlined. SEQ ID NOS: 111 and 112 are depicted.

Figure 34:
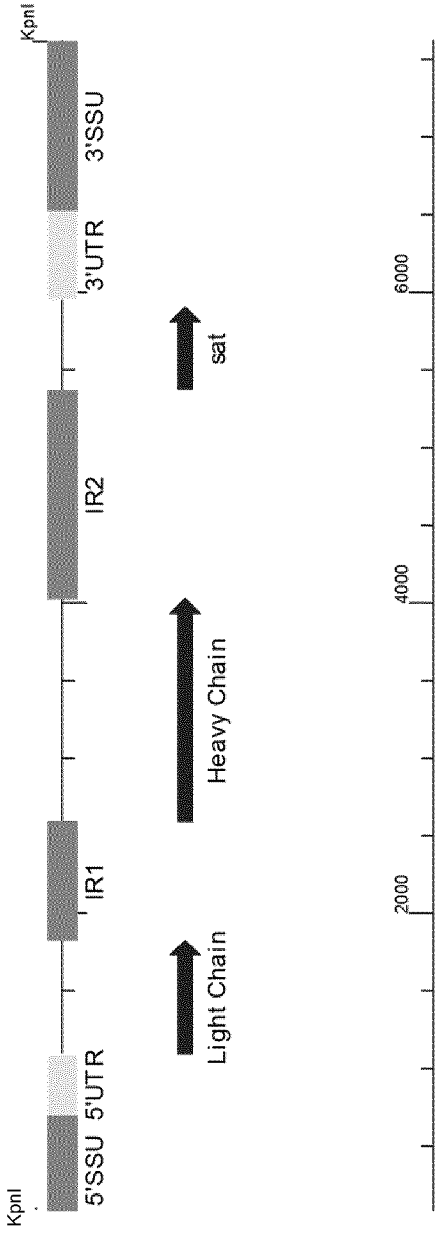

FIG. 34: Expression cassette containing recombinant Rituximab, an anti-CD20 monoclonal antibody, for stable integration in *Leishmania tarentolae*. Schematic representation of the relevant regions, 5' ssu are 5' homology sites for site specific integration by homologous recombination into ssu-locus encoding the 18S rRNA; 5'UTR are the 5' untranslated terminal repeats containing a splice leader acceptor sequence, Light chain sequence that was codon usage optimized for *Leishmania* containing the invertase secretion signal; IR1 a first intergenic region that contains a 3'UTR for polyadenylation and a 5' UTR for the downstream gene; heavy chain sequence that was codon usage optimized for *Leishmania* containing the invertase secretion signal; IR2 an second intergenic region that contains a 3'UTR for the polyadenylation and a 5' UTR for the downstream resistance marker (sat), which is followed by its 3' UTR and the 3' homology (3' ssu) region for site specific recombination into the genome. KpnI is the restriction enzyme used for obtaining the described expression cassette for transfection linear DNA, excised from the donor *E. coli* maintenance plasmid.

Figure 35:
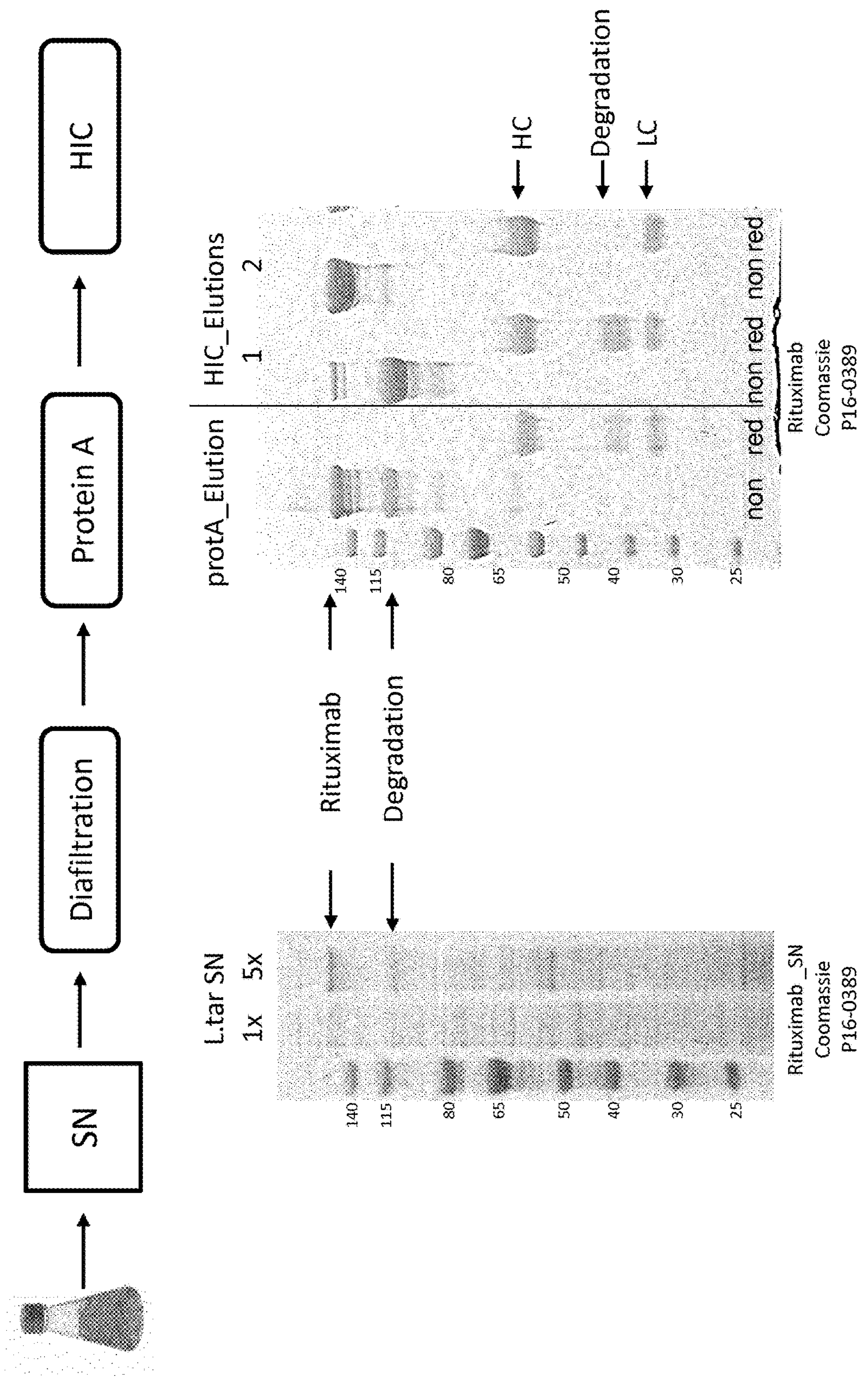

FIG. 35: Expression and purification of a full length monoclonal antibody from recombinant *Leishmania tarentolae* secreting Rituximab_LMTB. The workflow is described as boxes on top. Coomassie-stained SDS PAGE of the harvested supernatant and the diafiltrated and 5× concentrated SN is shown (left). The protein A elution (right) shows two major forms Coomassie stained, one migrating in non-reduced conditions ("non") on SDS PAGE as FL Rituximab and one degradation product at around 100 kDa. Under reduced conditions ("red"), HC, the degradation product and LC are separated. The hydrophobic interaction chromatography (HIC) elutions show separation of these two forms, when separated under non reducing or under reducing conditions. SDS PAGE gels are Coomassie stained.

Figure 36B:
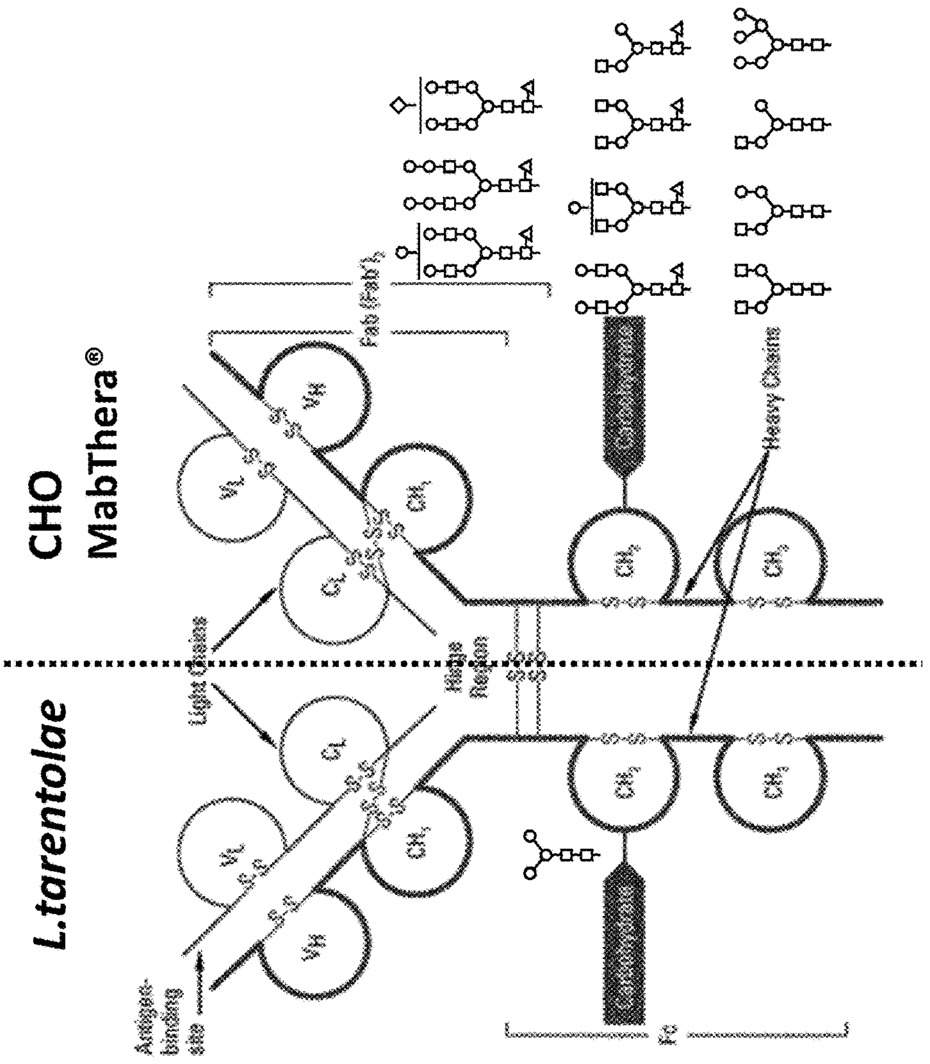
Figure 36A:
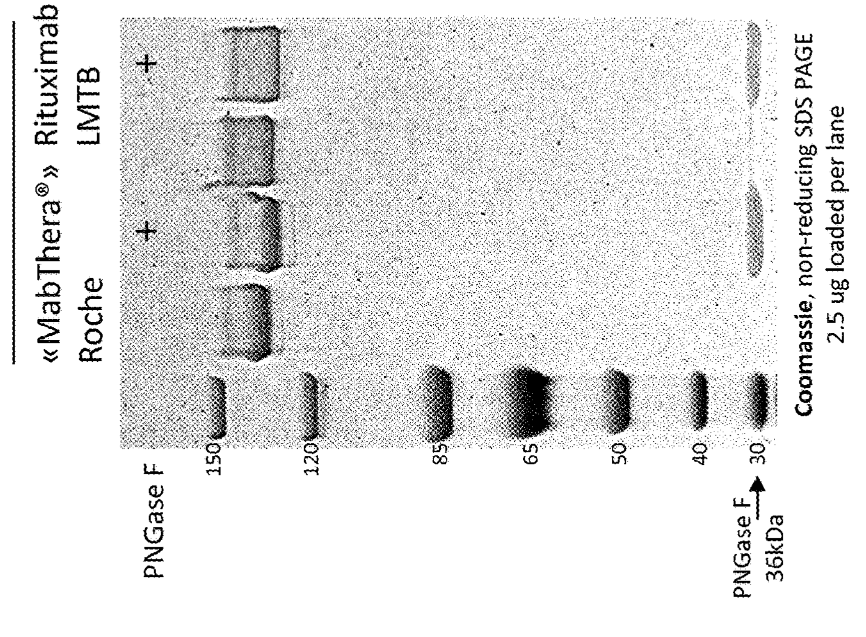

FIGS. 36A and 36B: Comparison of Rituximab_LMTB purified from recombinant *Leishmania* and Mabthera®, the commercial product of the same protein expressed in CHO cells. FIG. 36A: Coomassie stained SDS PAGE shows the FL antibodies under non reduced conditions without or with (+) PNGase F treatment to release the N-linked glycans. FIG. 36B shows schematic representation of the antibody molecule, the domains and the disulfide bridges. The N glycosite is indicated with Carbohydrate. On the left side of the cartoon molecule, the homogeneous Man3 N-glycan of *Leishmania* derived antibody is shown, whereas on the right side, the expected N-glycan microheterogeneity derived from CHO expressed antibodies is indicated.

Figure 37:
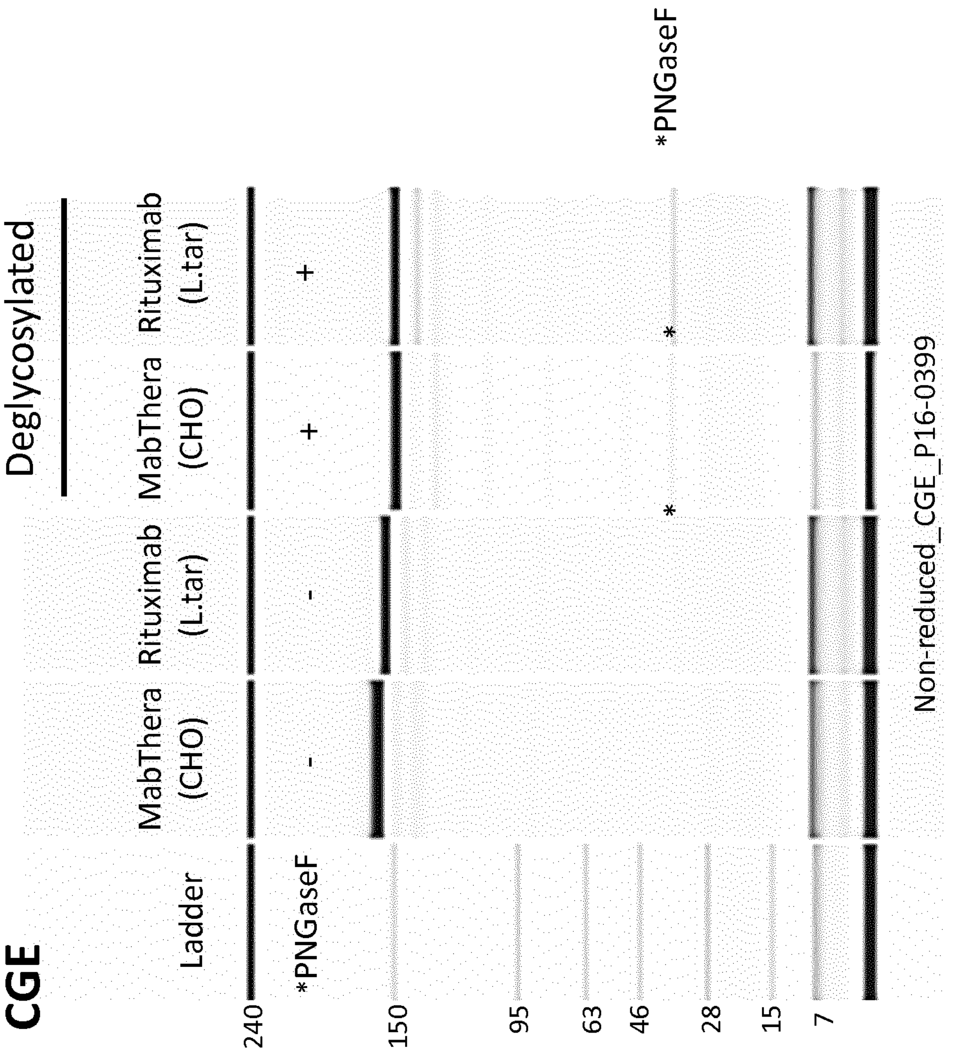

FIG. 37: Capillary Gel Electrophoresis and comparison of Rituximab_LMTB purified from recombinant *Leishmania* and Mabthera®, the commercial product of the same protein expressed in CHO cells. CGE shows the FL antibodies under non reduced conditions without (−) or with (+) PNGase F treatment to release the N-linked glycans.

Figure 38A:
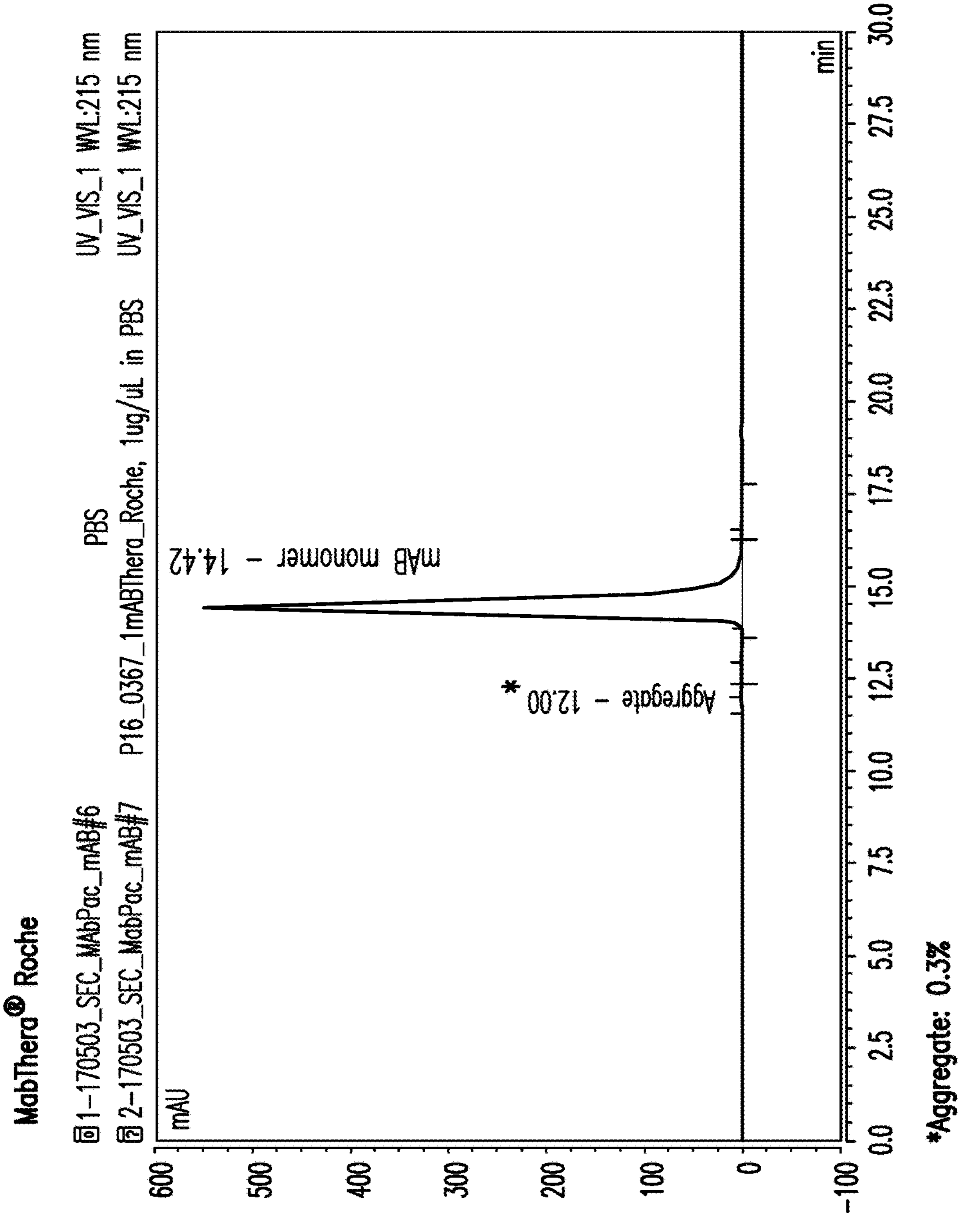
Figure 38B:
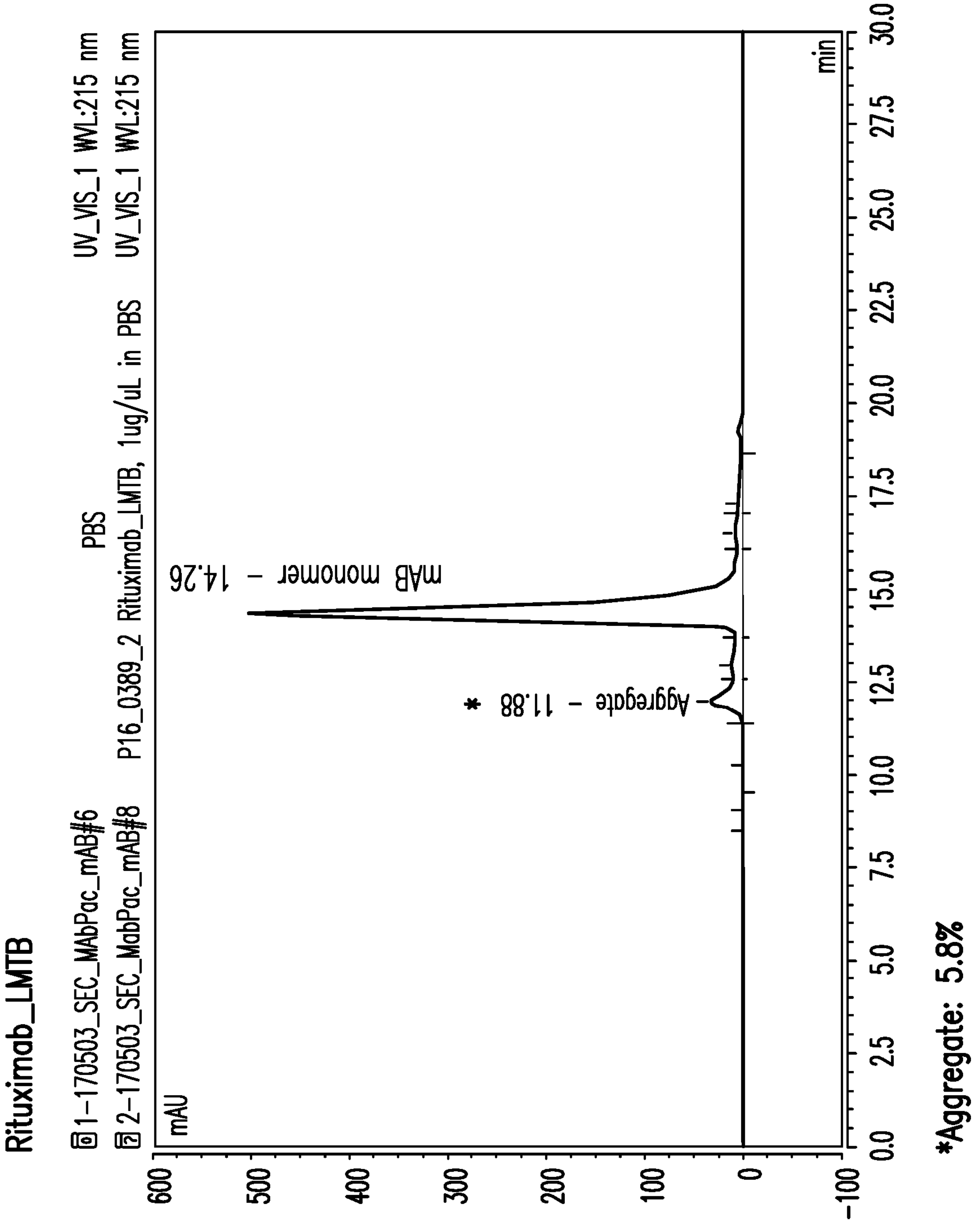

FIGS. 38A and 38B: Size exclusion chromatography and comparison of Rituximab_LMTB purified from recombinant *Leishmania* (FIG. 38B), and Mabthera®, the commercial product of the same protein expressed in CHO cells (FIG. 38A).

Figure 39A:
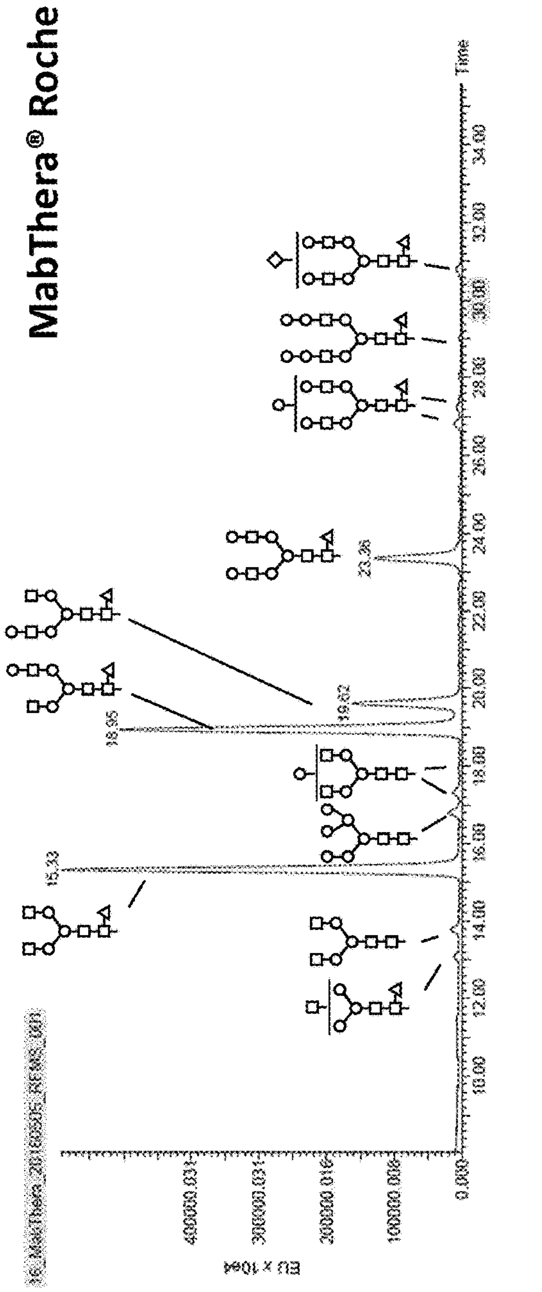
Figure 39B:
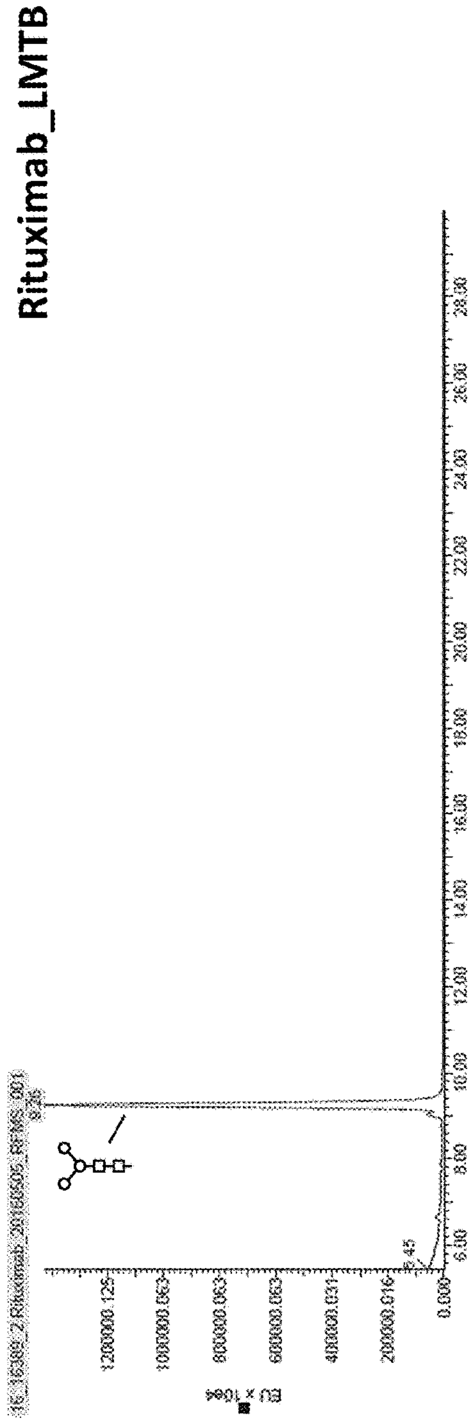

FIGS. 39A and 39B: N-glycan profiling using RF and comparison of Rituximab_LMTB purified from recombinant *Leishmania* (FIG. 39B), and Mabthera® (FIG. 39A), the commercial product of the same protein expressed in CHO cells. N-glycans were released by PNGase F and labeled with RF. UPLC separation is shown, m/z values are confirmed for N-glycan annotated above the peaks.

Figure 40:
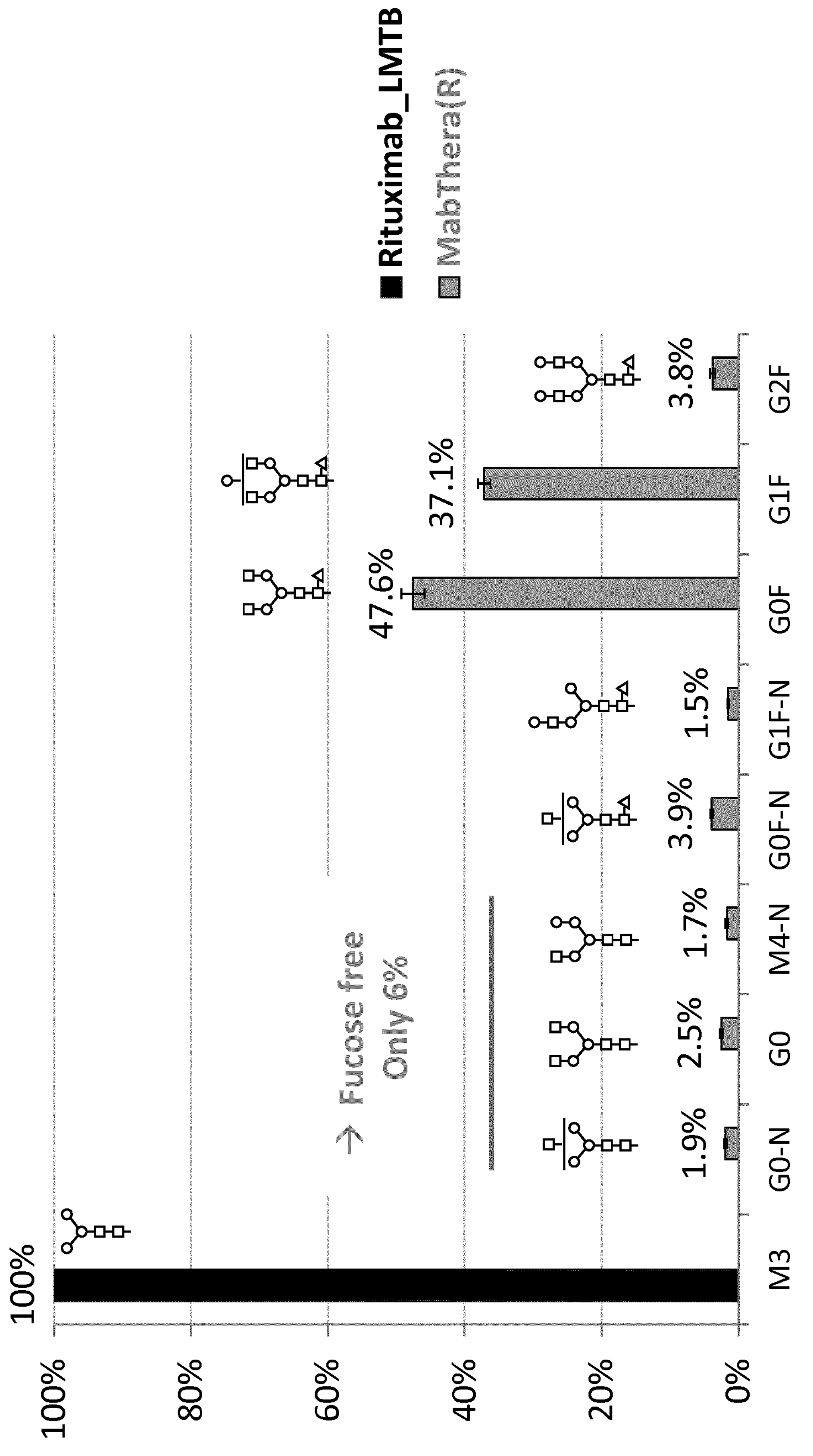

FIG. 40: N-glycan profiling using permethylation and quantitative comparison of Rituximab_LMTB purified from recombinant *Leishmania*, and Mabthera®, the commercial product of the same protein expressed in CHO cells. N-glycans were released by PNGase F and permethylated. Relative intensities (%) of N-glycans were calculated to establish N-glycan profiles for each spectrum. For this the sum of intensities of de-isotoped N-glycan peaks was determined and set as 100%. The relative intensity (%) of each glycan was then determined in relation to this value. Black bars Rituximab_LMTB and grey bars from Mabthera®, Roche. m/z values are confirmed for N-glycan annotated above the peaks, including confirmation by their fragmentation spectra.

Figure 41A:
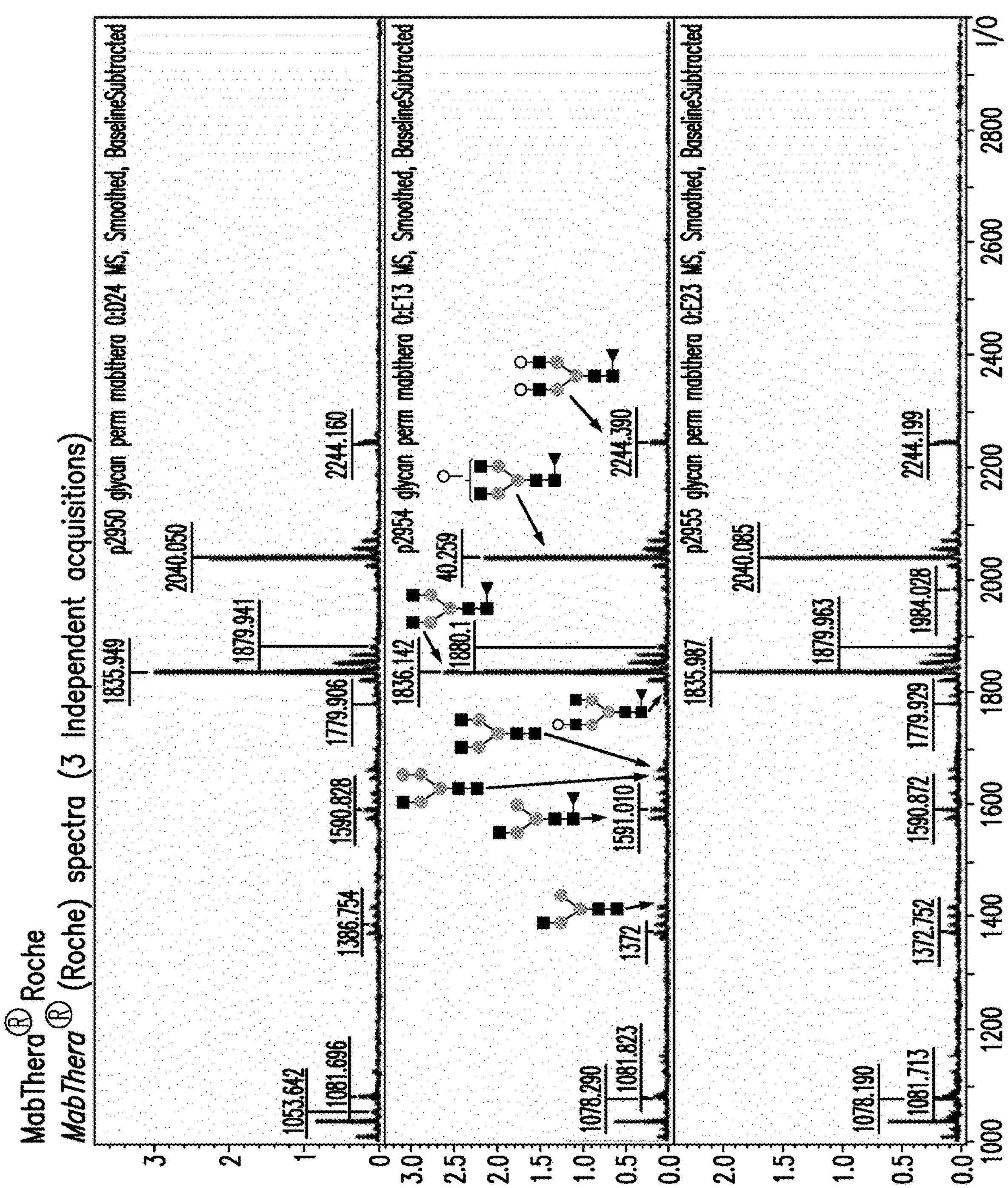
Figure 41B:
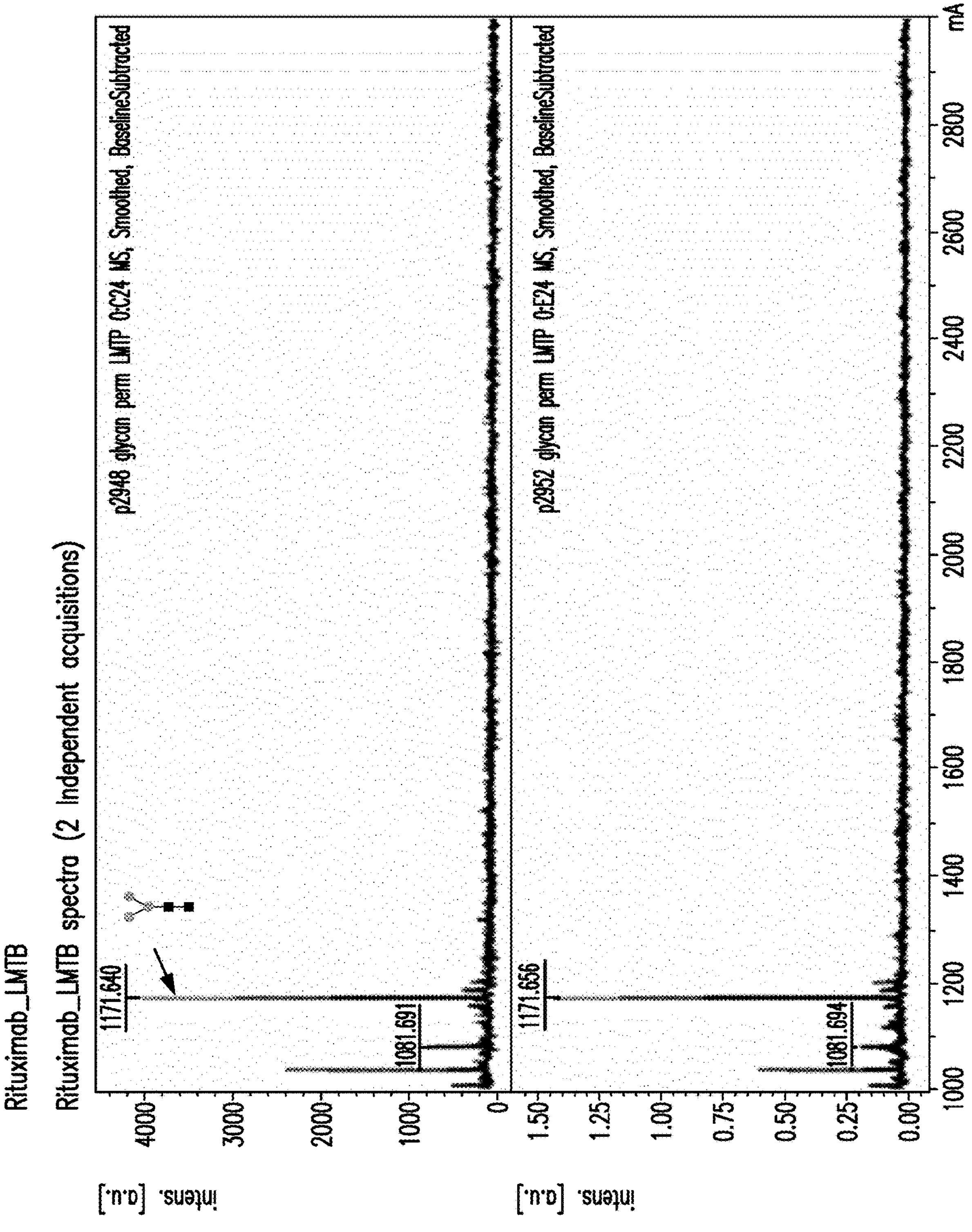

FIGS. 41A and 41B: N-glycan profiling using permethylation and comparison of Rituximab_LMTB purified from recombinant *Leishmania* (FIG. 42B), and Mabthera® (FIG. 42A), the commercial product of the same protein expressed in CHO cells. MALDI-TOF MS spectra of permethylated N-glycans released by PNGase F from Mabthera® at 3 different acquisitions (FIG. 48A) and Rituximab_LMTB at 2 independent acquisitions (FIG. 42B).

FIG. 42: Microheterogeneity of N-glycans and quantitative comparison of Rituximab_LMTB purified from recombinant *Leishmania*, Mabthera®, the commercial product of the same protein expressed in CHO cells and the glycoengineered third generation anti-CD-20 Gazyvaro®, Roche. N-glycans were released by PNGase F and permethylated. Relative intensities (%) of N-glycans were calculated to establish N-glycan profiles for each spectrum. For this the sum of intensities of de-isotoped N-glycan peaks was determined and set as 100%. The relative intensity (%) of each glycan was then determined in relation to this value. Gray bar from Rituximab_LMTB, Dark gray bars from Mabthera®, Roche and light gray bars from Gazyvaro®, Roche. m/z values are confirmed for N-glycan annotated above the peaks, including confirmation by their fragmentation spectra.

Figure 43A:
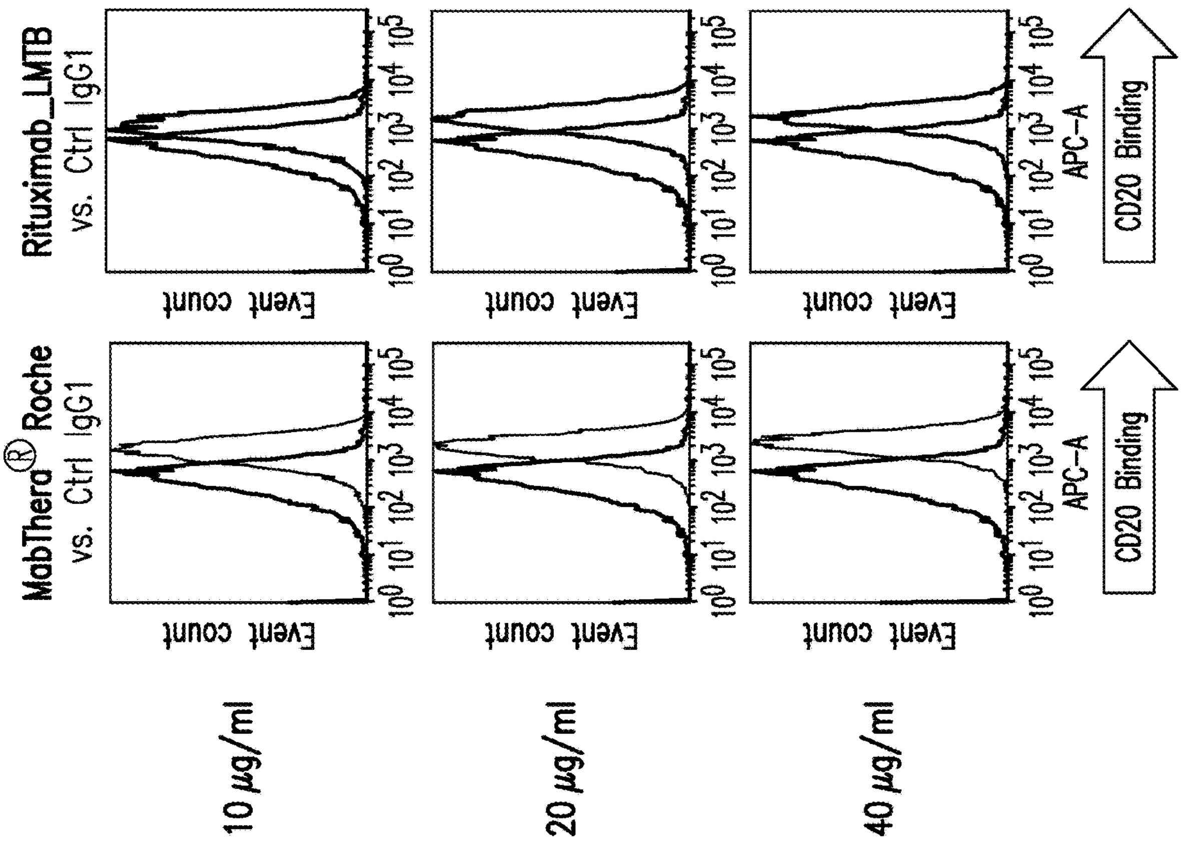
Figure 43B:
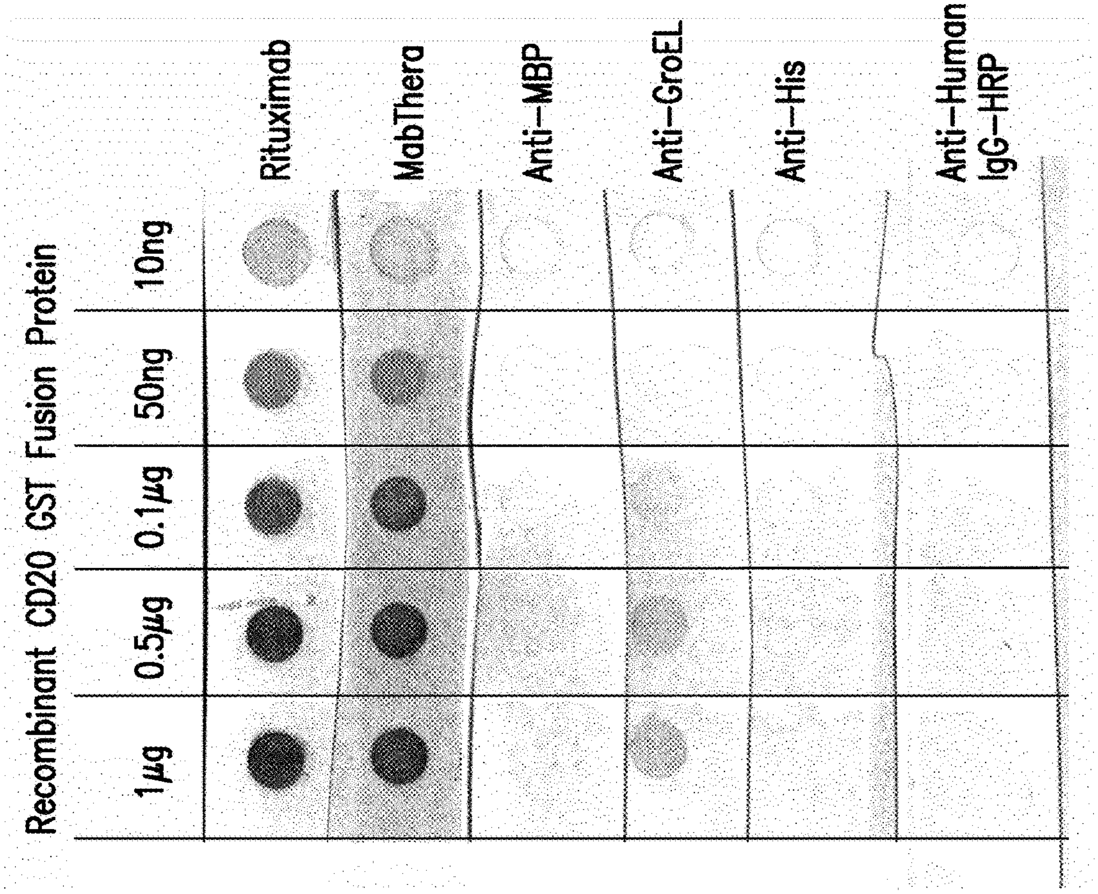

FIGS. 43A and 43B: Functionality tests of Rituximab_LMTB purified from recombinant *Leishmania* for antigen binding. FIG. 43A shows FACS histograms of Mabthera® or Rituximab_LMTB versus the control IgG1 kappa are shown. Raji cells expressing CD20 antigen were used to test the functionality of the anti-CD20 antibodies. The staining sequence was FcR blocking, IgG1 blocking, primary antibody Mabthera®, Rituximab_LMTB or the negative control IgG1 kappa with indicated concentrations, followed by the secondary antibody anti-IgG1 APC. After gating, each sample represents analysis of 10000-13000 cells. The arrows indicate the shift in mean fluorescence indicating binding of the anti-CD20 antibody to the CD20 antigen on the surface of Raji cells. FIG. 43B shows the results of CD20 recombinantly expressed as a GST fusion in *E. coli* that was spotted at ascending concentrations onto membranes. Different concentrations of Mabthera® or Rituximab_LMTB or control antibodies (anti-maltose binding protein, anti GroEL heat shock proteins from *E. coli*, or anti His IgG antibodies) or without primary antibody were used to incubate the membrane strips. After washing, the secondary antibody was anti-human IgG-HRP.

Figure 44:
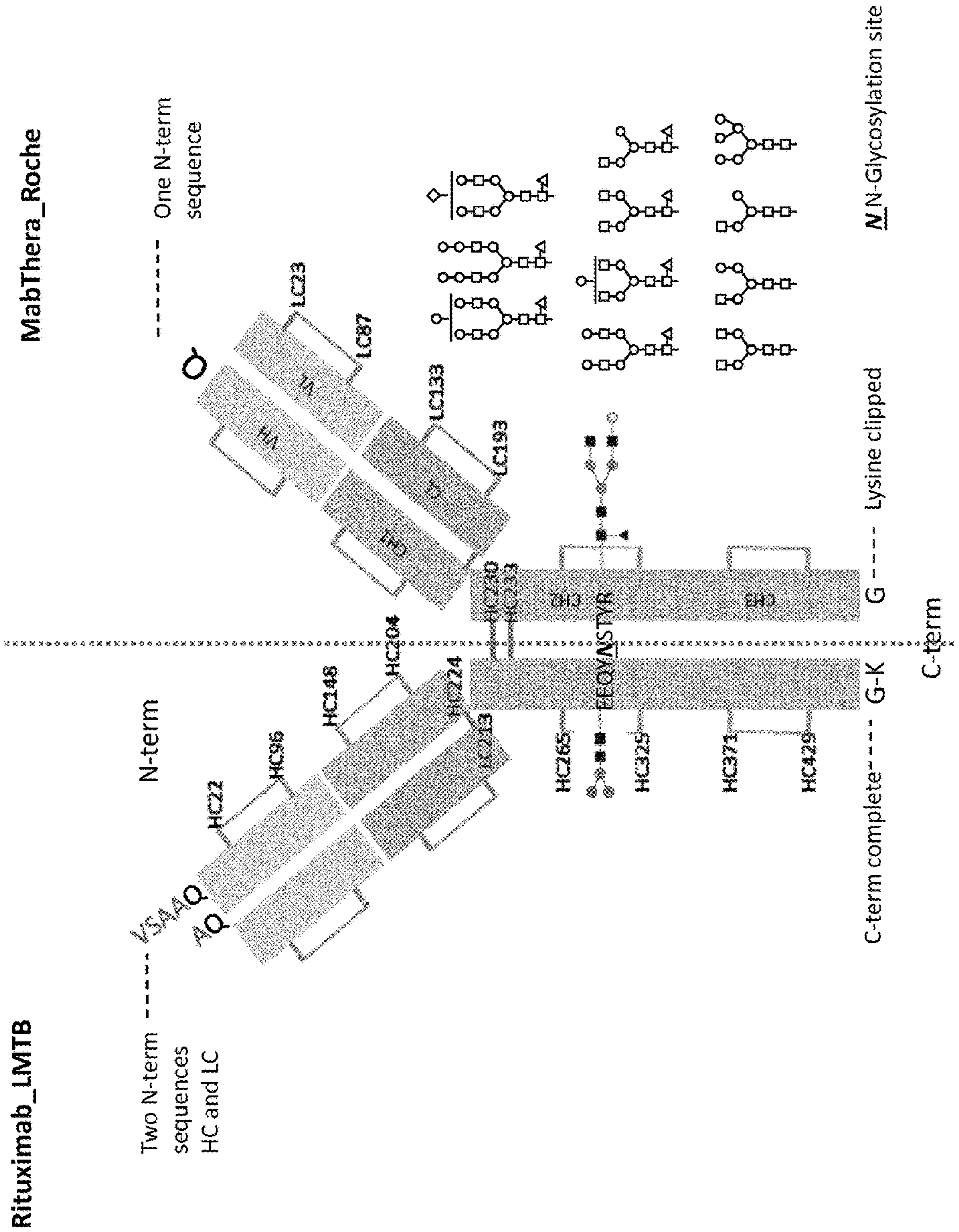

FIG. 44: Schematic representation and summary of the comparison of Rituximab_LMTB purified from recombinant *Leishmania* and Mabthera®, the commercial product of the same protein expressed in CHO cells. The N-terminal sequences of HC and LC, the C terminal amino acids and the glycan profile is indicated for Rituximab_LMTB on the right and for Mabthera® on the left. All indicated disulfide bridges were identified in both samples.

Figure 45:
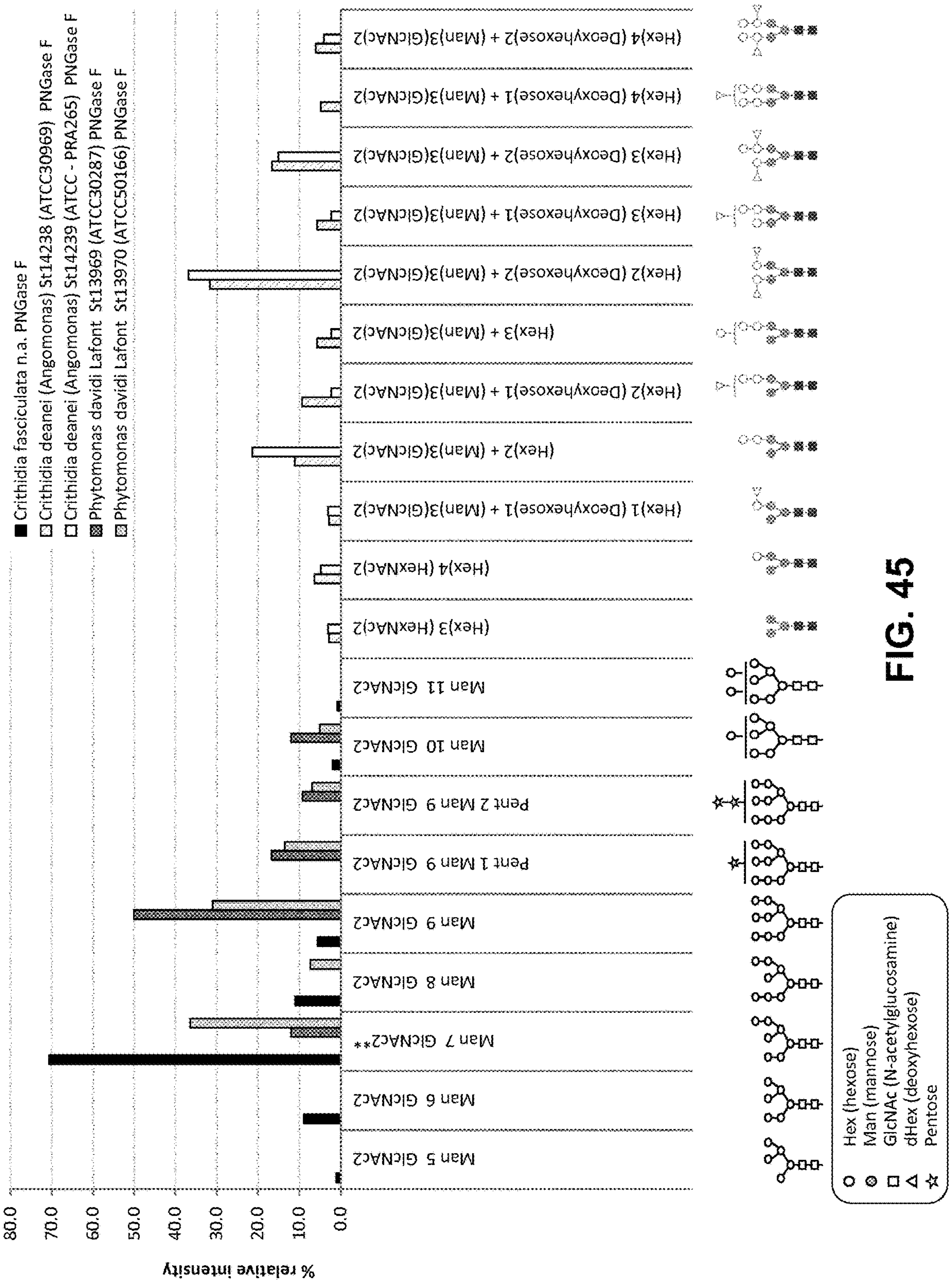

FIG. 45: N-glycan profiling using permethylation and quantitative comparison of different Kinetoplastida. N-glycans of *Crithidia fasciculata, Crithidia deanei* (*Angomonas*) and *Phytomonas davidii* were released after delipidation by PNGase F and permethylated. Relative intensities (%) of N-glycans were calculated to establish N-glycan profiles for each spectrum. For this the sum of intensities of de-isotoped N-glycan peaks was determined and set as 100%. The relative intensity (%) of each glycan was then determined in relation to this value. m/z values are confirmed for all N-glycan annotated above the peaks, including confirmation by their fragmentation spectra.

Figure 46A:
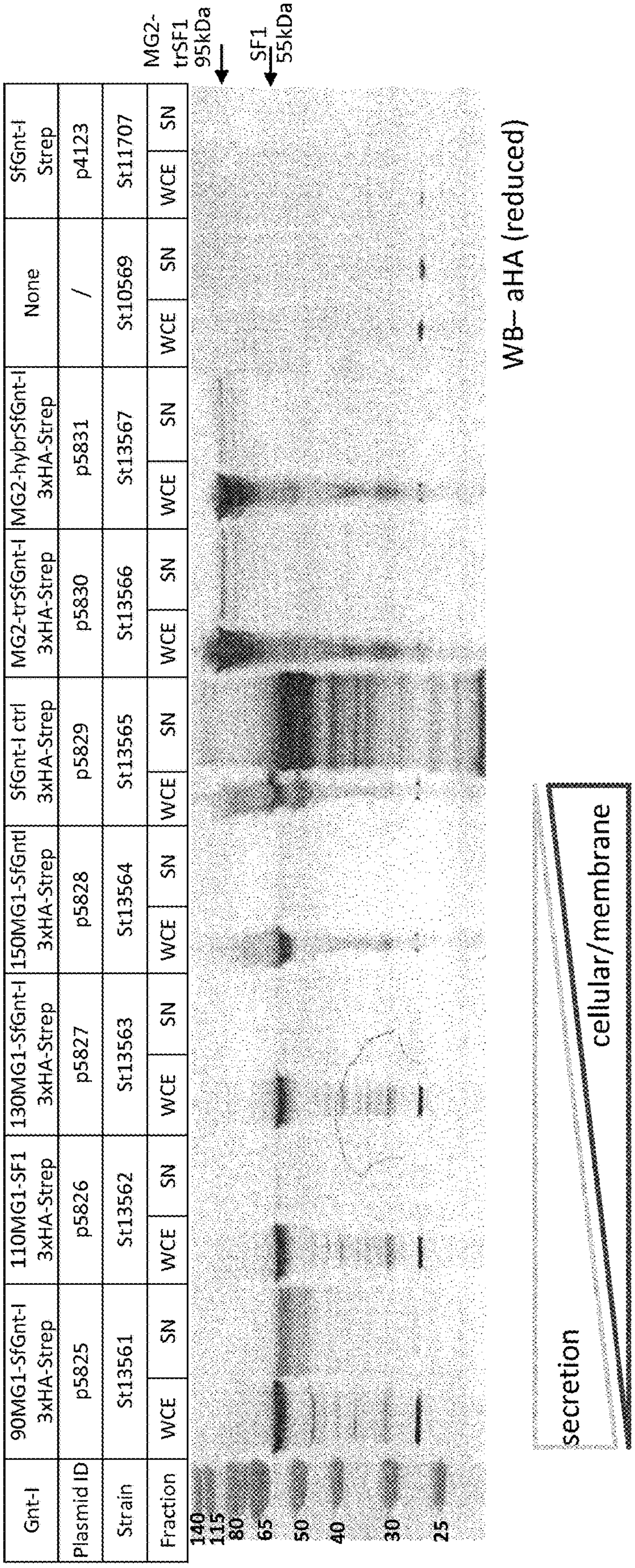
Figure 46B:
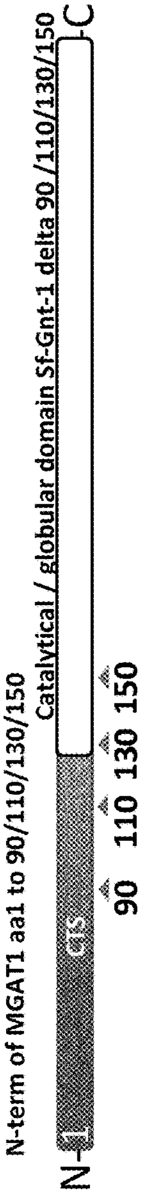

FIGS. 46A and 46B: Localization of hybrid Gnt variants of SfGnT-I. Native SfGnT-I or hybrids of SfGnT-I catalytic domain, schematically represented in FIG. 46B were expressed and precipitated from culture SN or from crude lysates with triton X (WCE) as shown in FIG. 46A.

Figure 47B:
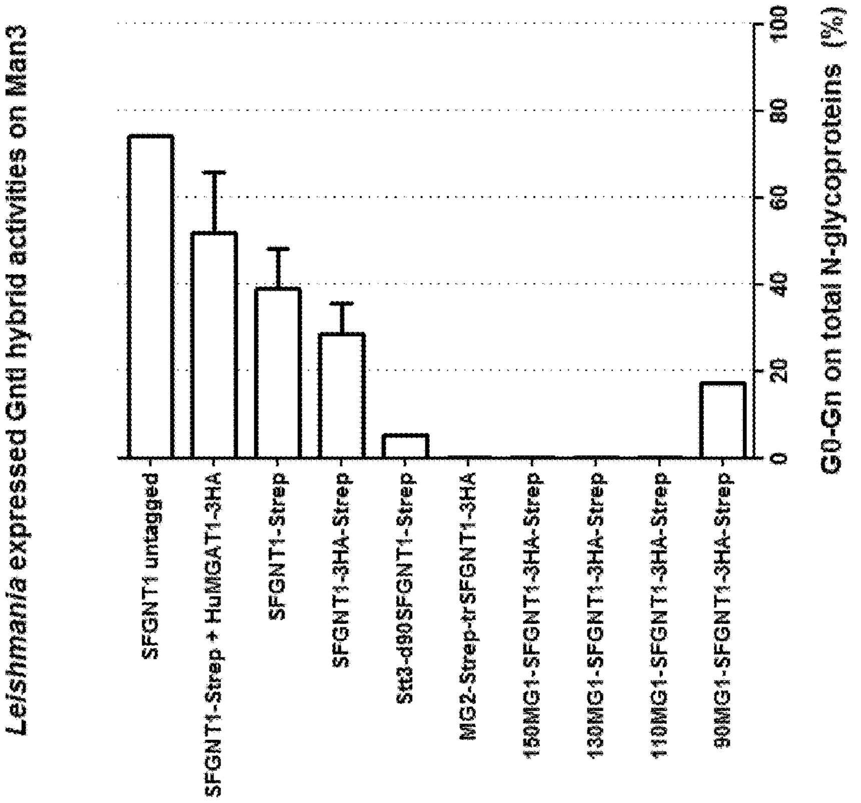
Figure 47A:
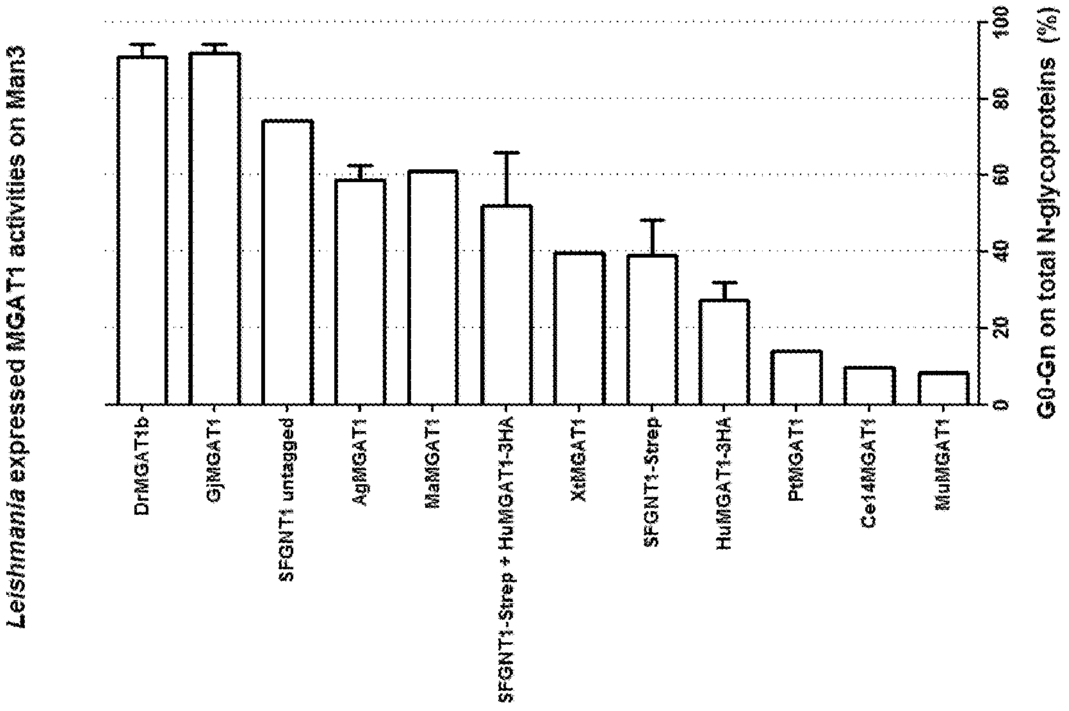

FIGS. 47A and 47B: N-glycan quantification using RF and comparisons of *Leishmania* expressing different Gnt-I (FIG. 47A) and different Sf-Gnt-I hybrids (FIG. 47B). Total N-glycans from cell pellets were released by PNGase F and labeled with RF. Relative quantification of the UPLC peaks is shown in % of G0-Gn conversion, representing the in vivo addition of the first GlcNAc for glycoengineering. Error bars indicate the standard deviation of several independent experiments. The m/z values were confirmed for G0-Gn and Man3 containing UPLC peaks, while no other peaks differing between mock and PNGase F released samples were found.

Figure 48A:
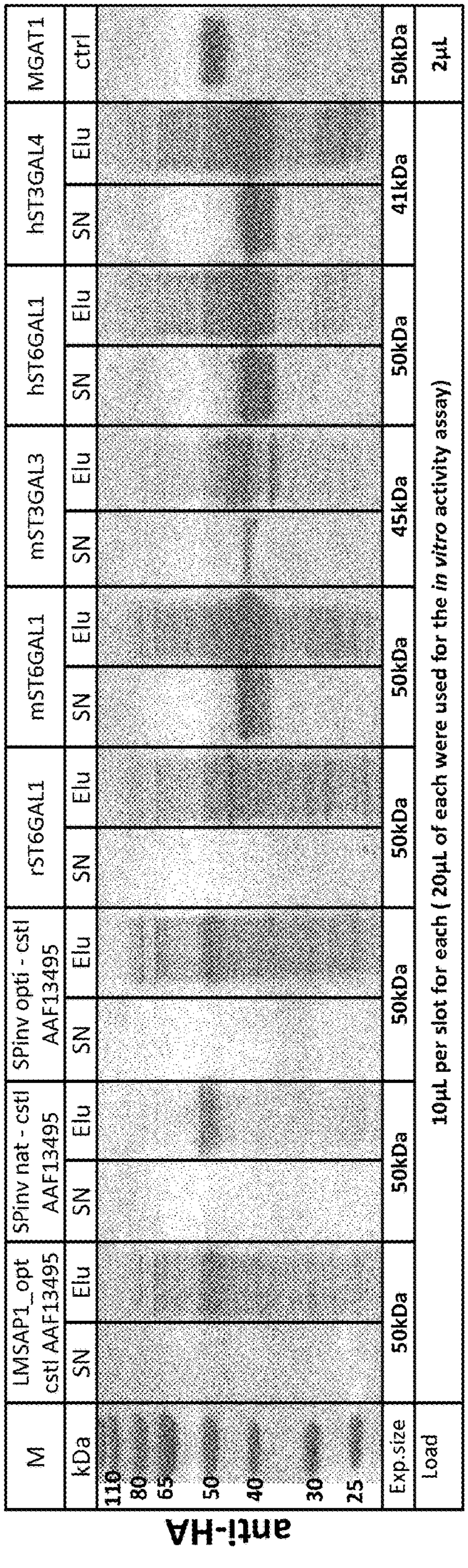
Figure 48B:
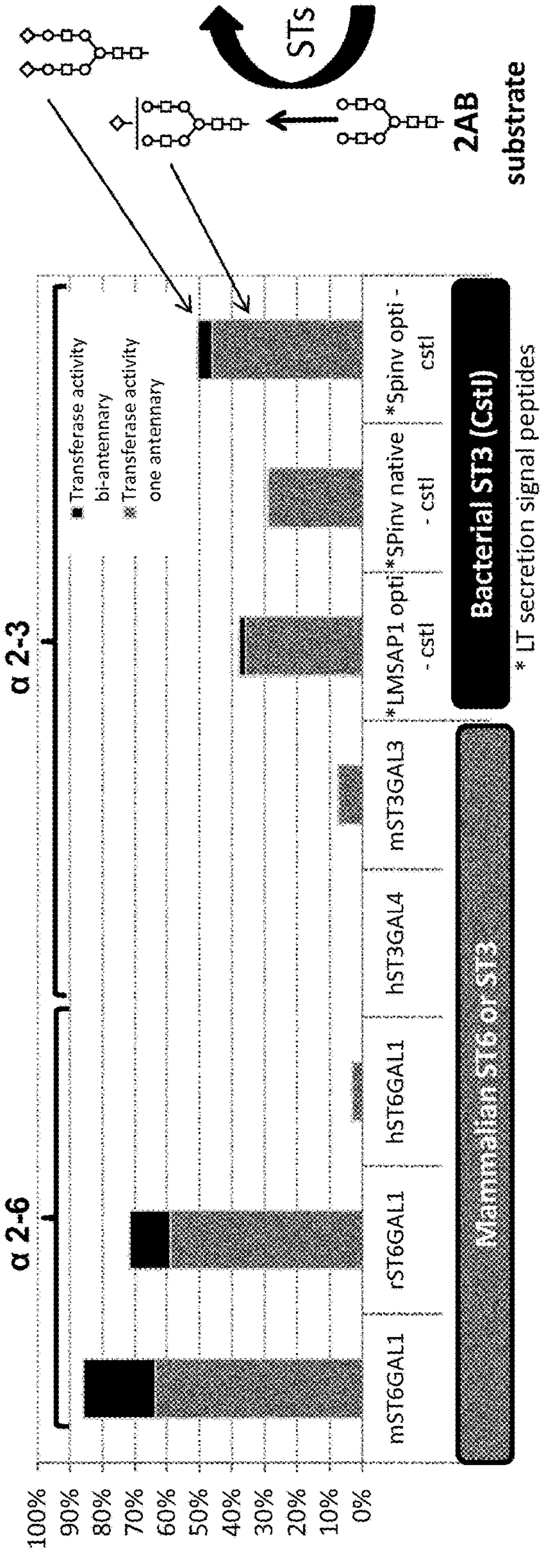

FIGS. 48A and 48B: Shown is the localization (FIG. 48A) and relative activity (FIG. 48B) of different sialyltransferases expressed in *Leishmania*. HA-tagged sialyltransferases are detected by anti-HA immunoblot from affinity enriched fractions (elu) from the triton solubilized cell lysates compared to cell culture SN. Elu are elutions used for in vitro assays (FIG. 48A).

Figure 49A:
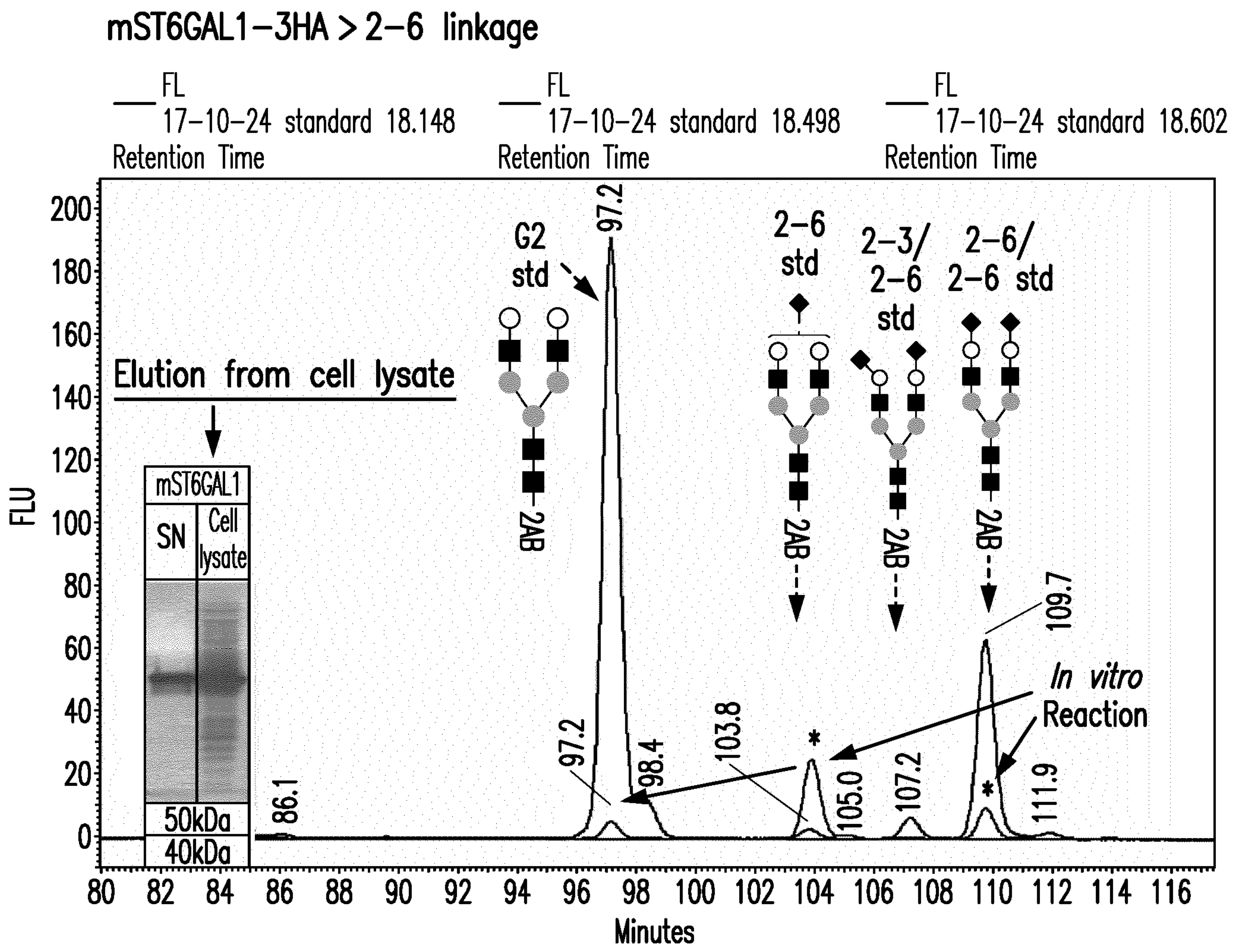
Figure 49B:
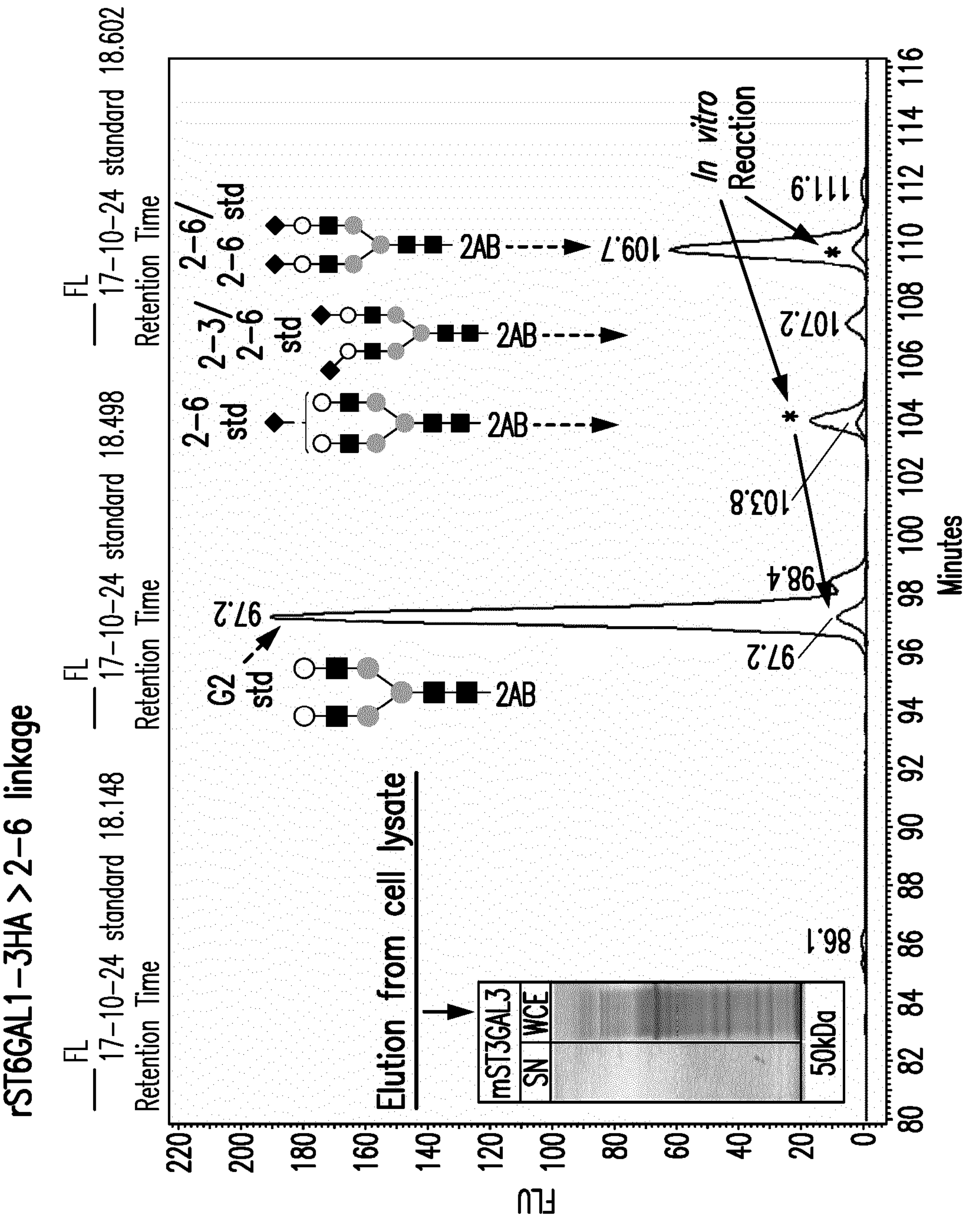
Figure 49C:
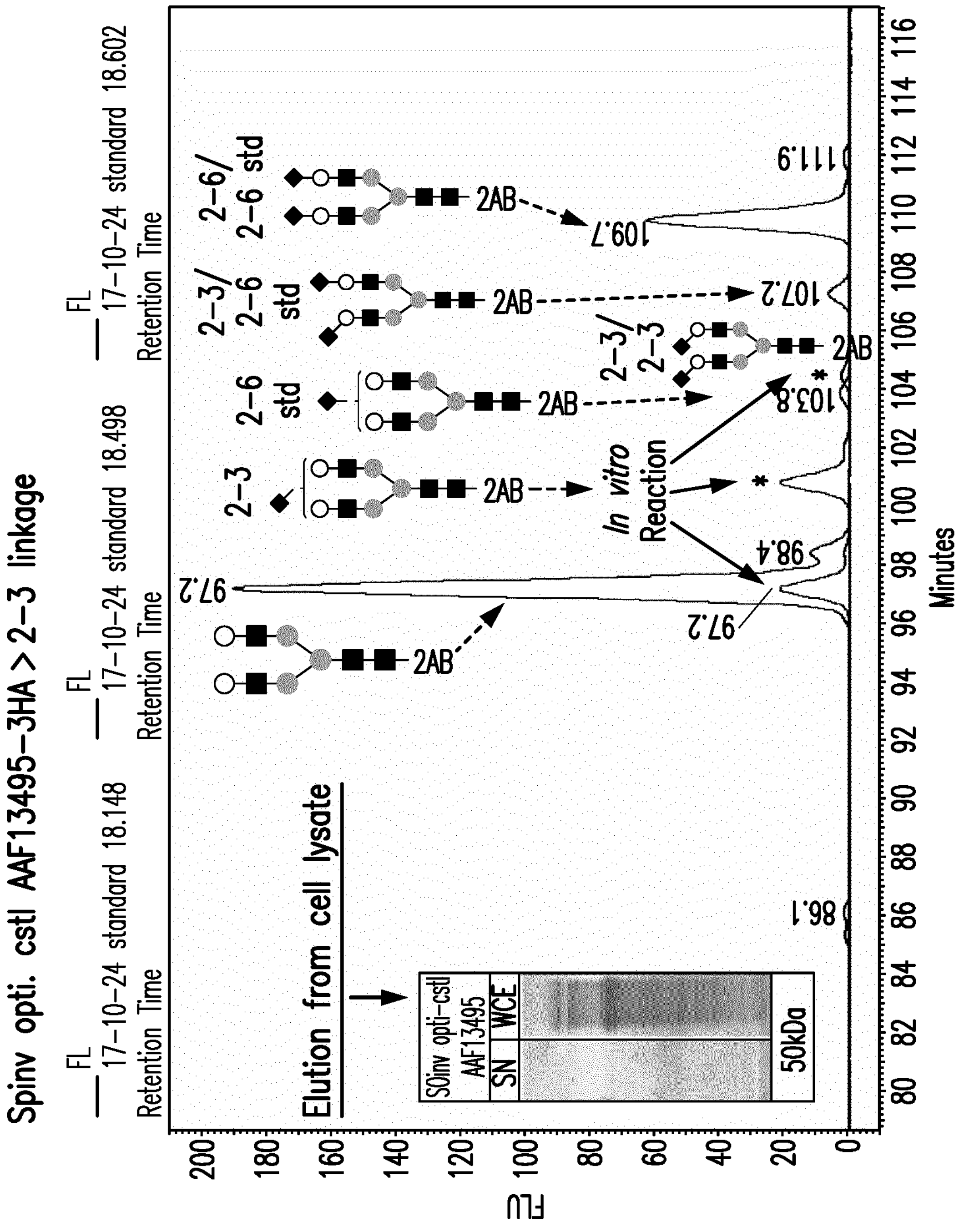
Figure 49D:
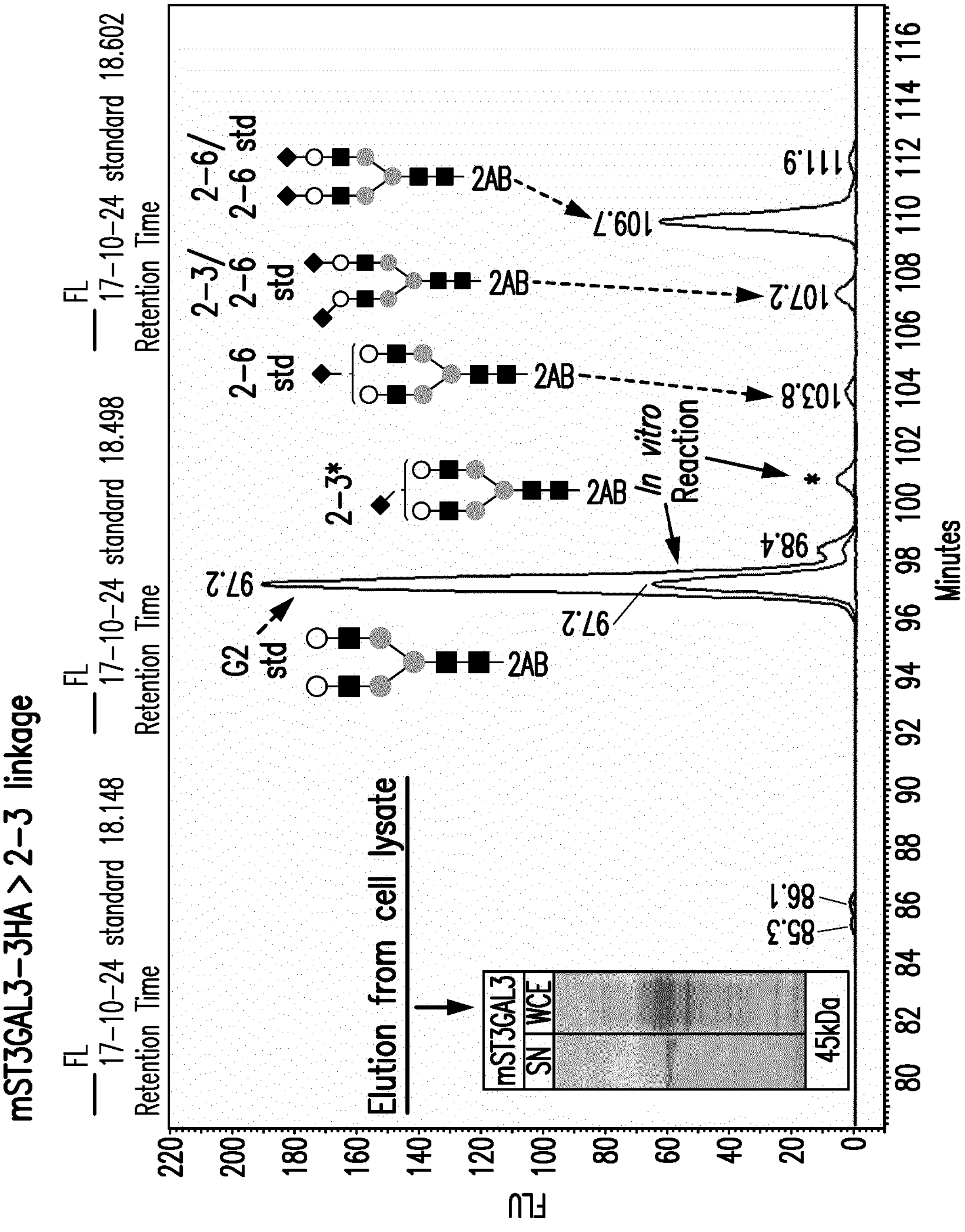

FIGS. 49A, 49B, 49C and 49D: In vitro activity on 2-AB labeled G2 standard of HA affinity-enriched sialyltransferases expressed in *Leishmania*. FIG. 49A: Murine ST6GAL1; FIG. 49B: Rat ST6GAL1, FIG. 49C: bacterial CstI containing optimized invertase secretion signal, FIG. 49D: murine ST3GAL3. In vitro reactions on G2 standard using HA enriched sialyltransferases are shown and RT comparisons are made to commercial standards G2, and sialylated G2S2 (dashed arrows). In vitro reactions are indicated with arrows and resulting glycan peaks with asterisks.

Figure 50A:
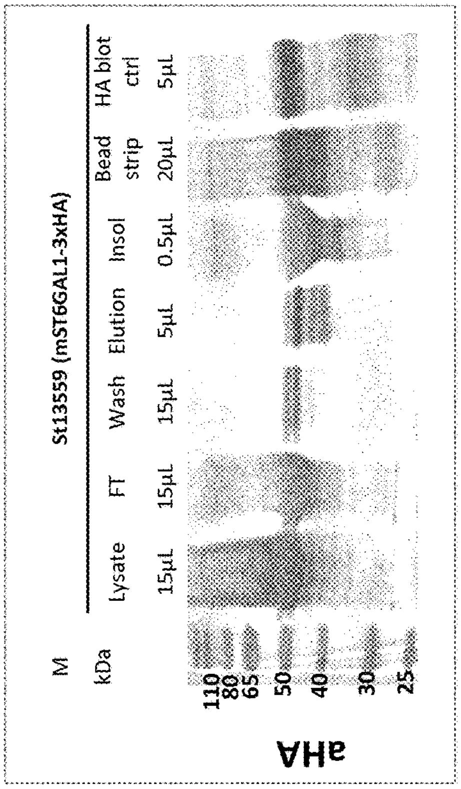
Figure 50B:
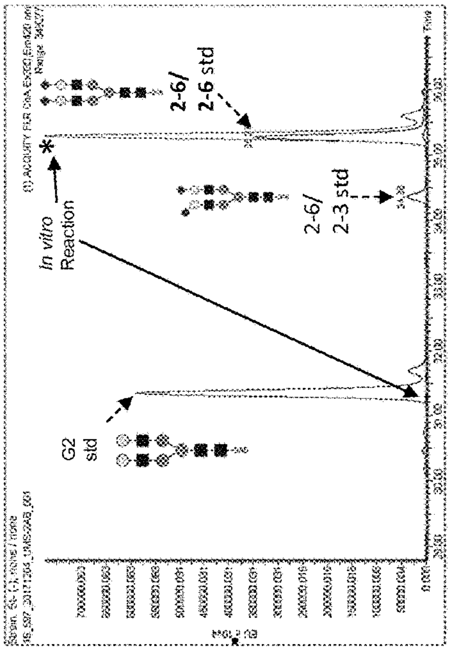
Figure 50C:
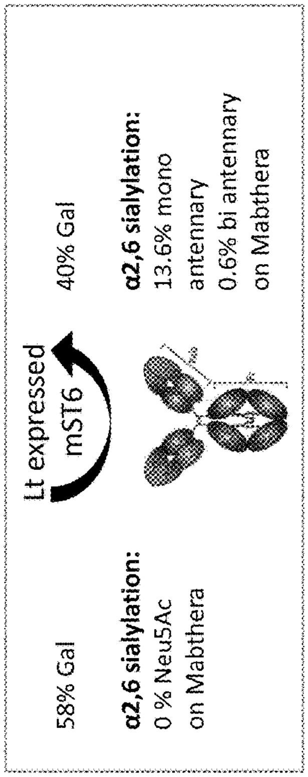
Figure 50D:
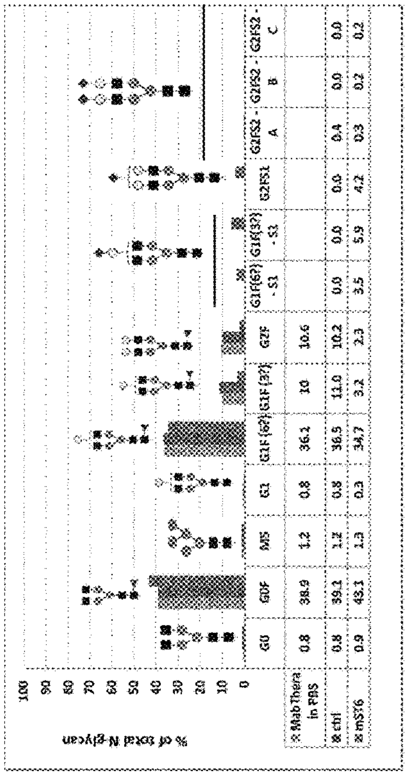
Figure 50E:
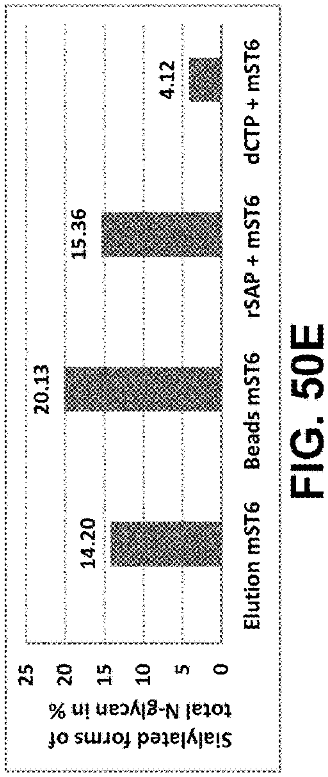

FIGS. 50A, 50B, 50C, 50D and 50E: *Leishmania* expressed and enriched mST6GAL1 can sialylate galactosylated N-glycans of a folded full-length mAb. FIG. 50A: HA affinity enrichment of *Leishmania* expressing murine ST6 from cell lysates and testing its activity on 2AB labelled G2 standard, determined to be 100% (FIG. 50B) and on MabThera Fc N-glycans FIG. 50C. The N-glycan composition was assessed by RF MS (FIG. 50D), on the mAb (light gray) and after in vitro reactions using either a mock lysate (black bars) or HA enriched mST6GAL1 (dark gray bars) of Protein A purified Mabthera. Summarized total sialylated glycans mono- and biantennary are indicated in FIG. 50E.

Figure 51:
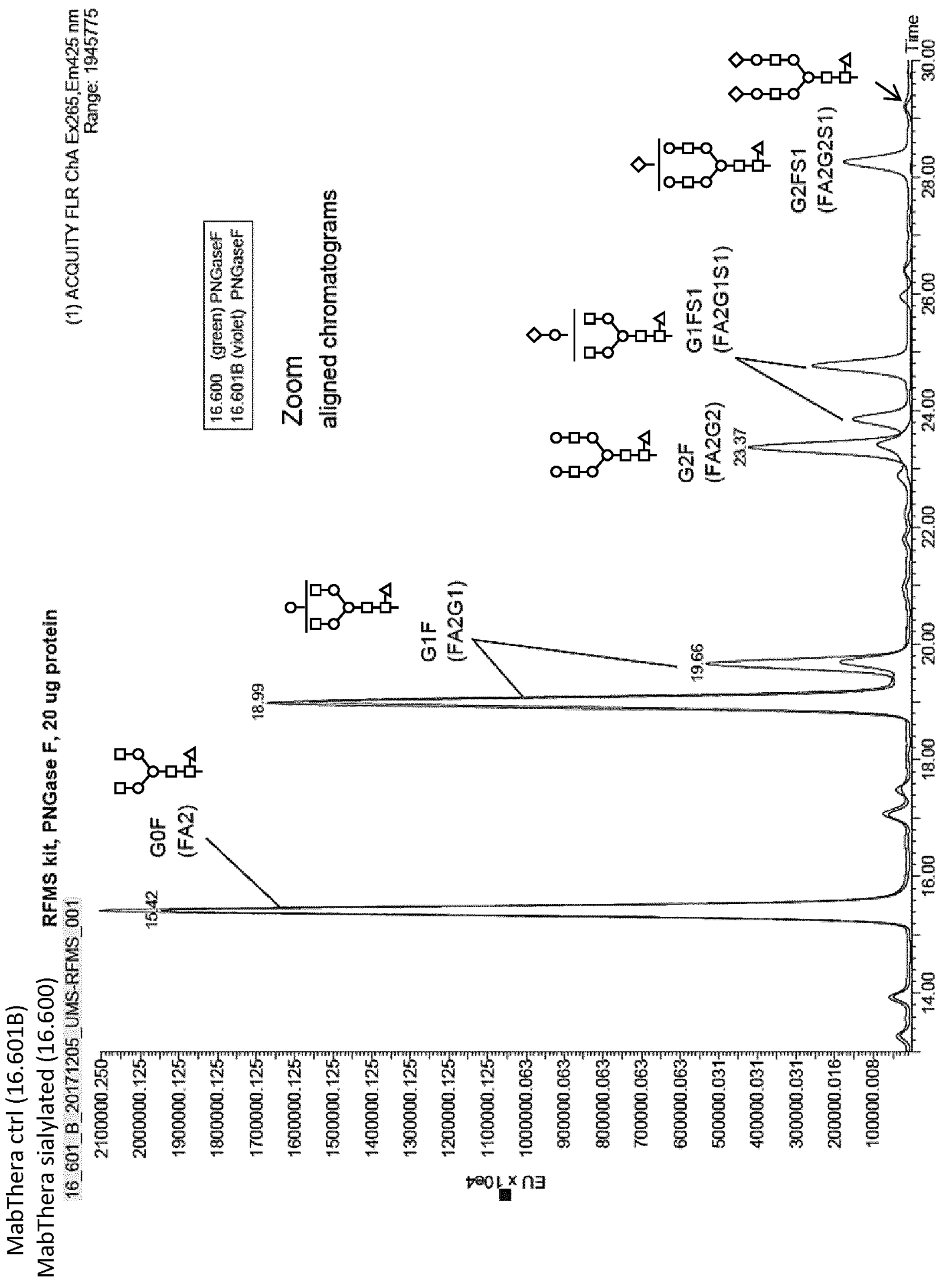
Figure 52A:
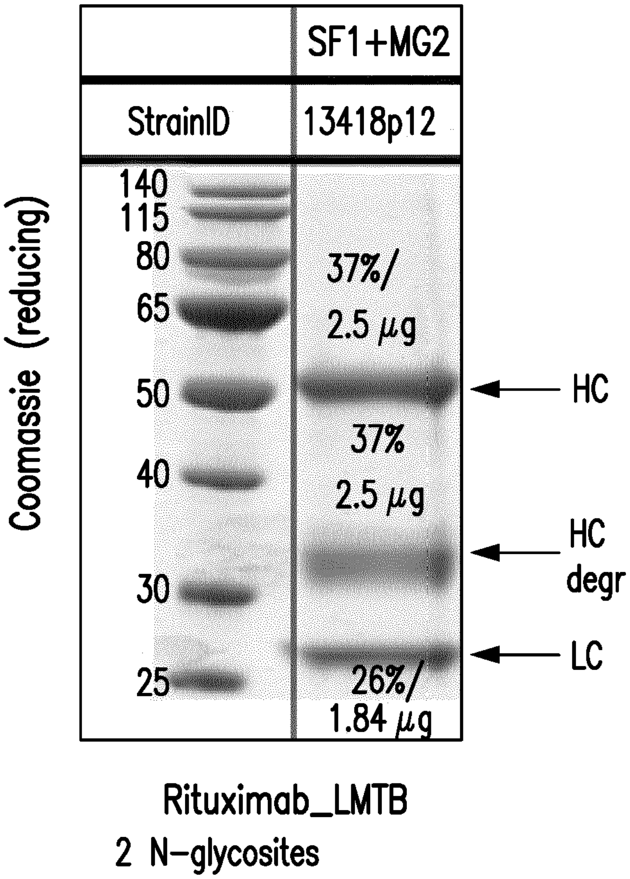
Figure 52B:
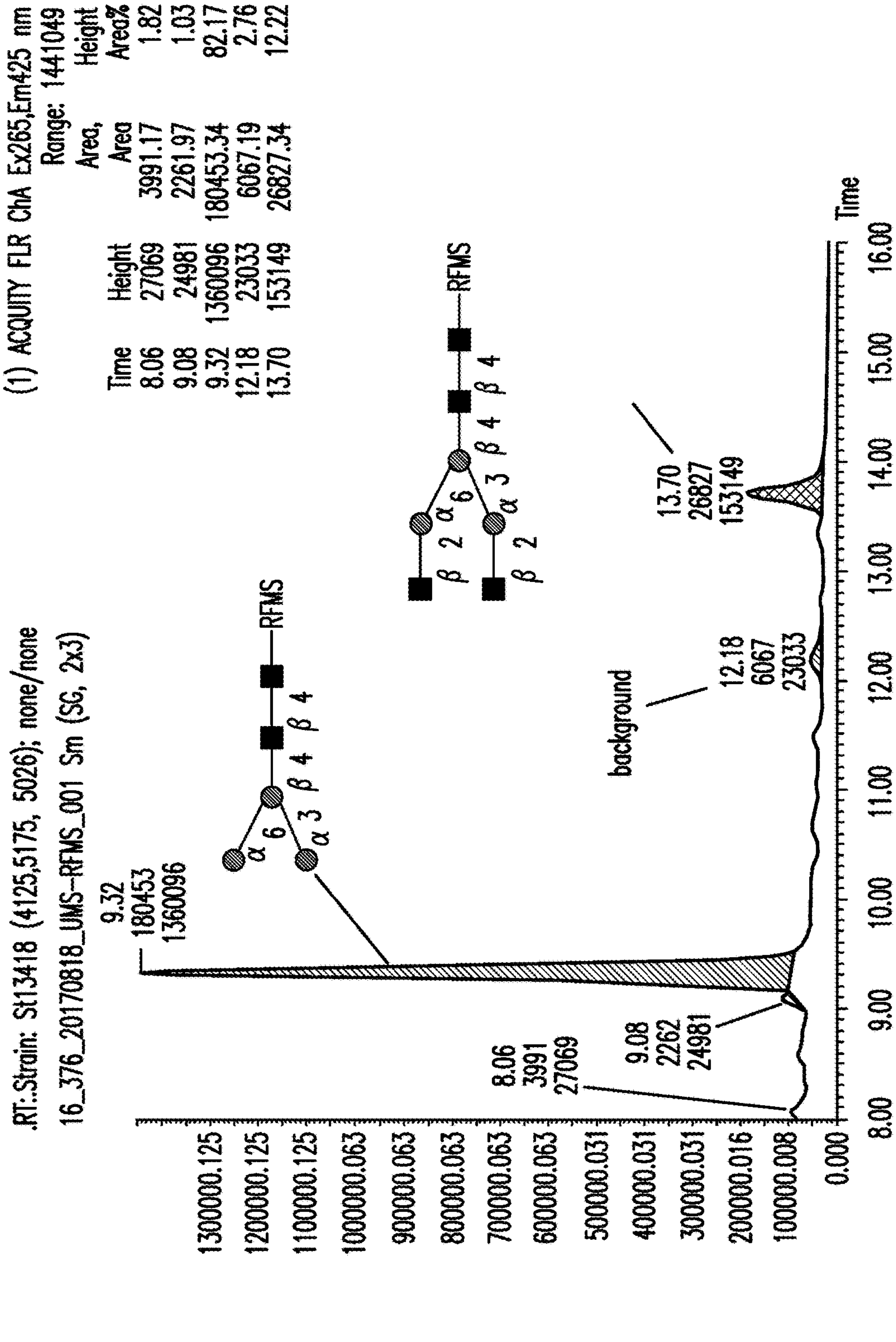

FIG. 51: *Leishmania* expressed and enriched mST6GAL1 can sialylate galactosylated N-glycans of a folded full length mAb as shown on the UPLC run with the N-glycan RF-MS profile of the mock reaction overlaid with the ST6 reaction FIGS. 52A and 52B: Glycoengineered strain stably transfected with Sf-Gnt-I and MGAT2 and episomally expressing Rituximab produces G0 N-glycan on Rituximab. Strain was grown in 1 L, secreted Rituximab was purified from the supernatant by Protein A (FIG. 52A), and used for PNGase F and RF-MS analysis (FIG. 52B) and semi-quantified for Man3.Fig.

FIG. 53: Schematically represented CMP-Neu5Ac pathway with prokaryotic and eukaryotic enzymes that can be recombinantly added to *Leishmania* for glycoengineering.

7. DETAILED DESCRIPTION

The present invention relates to unicellular Kinetoplastida eukaryotic host cells, which have been modified to produce homogeneous and fully-function customized N-glycans with a high site occupancy on therapeutic proteins by the properties of the native host cell and the combination with the heterologous expression of a set of glycosyltransferases, including N-acetyl glucosamine transferases, galactosyltransferase, and sialyltransferases, to become host-strains for the production of mammalian, e.g., human therapeutic glycoproteins.

The invention provides nucleic acid molecules and combinatorial libraries, which can be used to successfully target and express mammalian enzymatic activities (such as those involved in N-acetylglucosamine elongation, galactosylation and sialylation) to intracellular compartments in the kinetoplastid eukaryotic host cell. Design of a CMP-sialic acid biosynthetic pathway for the production of sialylated glycoproteins is also provided.

7.1 Host Cells

In certain embodiments, the invention provides an engineered host cell, which can be used to express and target any desirable gene(s) involved in glycosylation. The present invention provides eukaryotic host cells, which have been modified to produce function-customized and homogeneous N-glycans on proteins by the heterologous expression of a set of glycosyltransferases, including N-acetylglucosamine transferases, galactosyltransferase, and sialyltransferases, to become host-strains for the production of mammalian, e.g., human therapeutic glycoproteins.

The invention also provides an engineered host cell which can be used to express and target a full length therapeutic antibody. The novel host cell synthesizes, expresses and secretes homogeneous and function-customized N-glycans on glycoproteins, such as erythropoietin or anti-CD20 (Rituximab).

The invention described herein is not limited to the use of specific enzymes, genes, plasmids and constructs disclosed herein. A person of skill could use any homologues, variants and derivatives of the genes involved in the synthesis of N-acetyl glucosamine transferase, Galactosyltransferase, Sialyltransferase, and a CMP-Sia Biosynthetic Pathway Enzyme.

In a particular embodiment, provided herein is a *Leishmania* host cell comprising (a) a recombinant nucleic acid encoding a target protein; and (b) a recombinant nucleic acid encoding a heterologous glycosyltransferase. In certain embodiments, the heterologous glycosyltransferase is an N-acetyl glucosamine transferase; and/or a heterologous galactosyltransferase; and/or a heterologous sialyltransferase. In some embodiments, provided herein is a host cell comprising two or more N-acetyl glucosamine transferases. In other embodiments, the host cell comprising a heterologous sialyltransferase further comprises a heterologous CMP-Sia biosynthetic pathway proteins capable of generating CMP-NeuAc.

In one aspect, provided herein are *Leishmania* host cells capable of producing glycosylated proteins, wherein the *Leishmania* host cells comprise (i) a Native OST or a heterologous/recombinant OST; (ii) nucleotides encoding heterologous N-acetyl glucosamine transferase, Galactosyltransferase, Sialyltransferase, and a CMP-Sia Biosynthetic Pathway enzyme, or modified versions thereof; and (iii) nucleotides encoding recombinant target protein and modified versions of recombinant target protein. In further embodiments, the amino acid sequence of the said N-acetyl glucosamine transferase, galactosyltransferase, and/or sialyltransferase is derived from an N-acetyl glucosamine transferase, a galactosyltransferase, or a sialyltransferase listed in Table 9, or any functional homologue, isoform or variant thereof.

In another embodiment, provided herein is a host cell, wherein one or more endogenous enzymes from the N-glycan biosynthesis pathway have been deleted, mutated and/or functionally inactivated. In a further embodiment, the endogenous enzyme that has been deleted, mutated and/or functionally inactivated in the said host cell is encoded by the alg gene. In another embodiment, provided herein is a host cell, wherein one or more genes encoding endogenous enzymes from the N-glycan biosynthesis pathway have been deleted, mutated and/or functionally inactivated. In yet another embodiment, the gene or genes encoding endogenous enzyme or enzymes from the N-glycan biosynthesis pathway is deleted, mutated and/or functionally inactivated using any of the standard techniques (for example, by site specific homologous recombination or random mutagenesis) known in the art. In a certain embodiment, the host cell is a strain of *Leishmania* that does not include one or more endogenous enzymes from the N-glycan biosynthesis pathway.

In certain embodiments, the *Leishmania* host cell is a *Leishmania tarentolae* cell. In a particular embodiment, provided herein is a *Leishmania tarentolae* host cell comprising (a) a recombinant nucleic acid encoding a target protein; and (b) a recombinant nucleic acid encoding a heterologous glycosyltransferase. In certain embodiments, the heterologous glycosyltransferase is an N-acetyl glucosamine transferase; and/or a heterologous galactosyltransferase; and/or a heterologous sialyltransferase. In some embodiments, provided herein is a host cell comprising two or more N-acetyl glucosamine transferases. In other embodiments, the host cell comprising a heterologous sialyltransferase further comprises a heterologous CMP-Sia biosynthetic pathway proteins capable of generating CMP-NeuAc.

In one aspect, provided herein are *Leishmania tarentolae* host cells capable of producing glycosylated proteins, wherein the *Leishmania tarentolae* host cells comprise (i) a Native OST or a heterologous/recombinant OST; (ii) nucleotides encoding heterologous N-acetyl glucosamine transferase, Galactosyltransferase, Sialyltransferase, and a CMP-Sia Biosynthetic Pathway enzyme, or modified versions thereof, and (iii) nucleotides encoding recombinant target protein and modified versions of recombinant target protein. In further embodiments, the amino acid sequence of the said N-acetyl glucosamine transferase, galactosyltransferase, and/or sialyltransferase is derived from an N-acetyl glucosamine transferase, a galactosyltransferase, or a sialyltransferase listed in Table 9, or any functional homologue, isoform or variant thereof.

In another embodiment, provided herein is a host cell, wherein a *Leishmania* signal and/or retention sequence is added to the N-acetyl glucosamine transferase, galactosyltransferase, and/or sialyltransferase, wherein the signal sequence targets the N-acetyl glucosamine transferase, galactosyltransferase, and/or sialyltransferase to the endoplasmic reticulum of the *Leishmania* host cell, and wherein the retention sequence retains the N-acetyl glucosamine transferase, galactosyltransferase, and/or sialyltransferase in the endoplasmic reticulum or Golgi apparatus. In another embodiment, said retention sequence retains the N-acetyl glucosamine transferase and/or galactosyltransferase in the endoplasmic reticulum of the host cell. In another embodiment, said retention sequence retains the N-acetyl glucosamine transferase and/or galactosyltransferase in the cis Golgi compartment of the host cell. In another embodiment, said retention sequence retains the N-acetyl glucosamine transferase and/or galactosyltransferase in the medial Golgi compartment of the host cell. In another embodiment, said retention sequence retains the galactosyltransferase in the trans Golgi compartment of the host cell. In another embodiment, said retention sequence retains the sialyltransferase in the trans Golgi compartment of the host cell. In another embodiment, the retention sequence retains the sialyltransferase and galactosyltransferase in the trans Golgi compartment of the host cell. In another embodiment, said signal sequence is processed and removed. In further embodiments, said retention sequence is a cytoplasmic-transmembrane-stem (CTS) sequence derived from a *Leishmania tarentolae* protein. In another embodiment, said CTS sequence is derived from *Leishmania tarentolae* MAN1, NTPDase 1, or NTPDase 2. In another embodiment, said CTS sequence comprises the sequence of SEQ ID NO: 24, SEQ ID NO: 25, or SEQ ID NO: 26 or functionally active fragments thereof. In another embodiment, said CTS is derived from *Leishmania tarentolae* MAN1. In another embodiment, said CTS sequence comprises the sequence of SEQ ID NO: 24 or functionally active fragments thereof. In further embodiments, said retention sequence comprises a GRIP sequence derived from *Leishmania* or functionally active fragments thereof. In another embodiment, said GRIP sequence comprises the sequence of SEQ ID NO: 27, or a functionally active fragments thereof. In further embodiments, said retention sequence comprises a CTS sequence derived from a *Leishmania* protein, or a functionally active fragment thereof, and a GRIP sequence derived from *Leishmania* or a functionally active fragment thereof.

In another embodiment, provided herein is a *Leishmania* host cell comprising (a) a recombinant nucleic acid encoding a target protein; and (b) a recombinant nucleic acid encoding an N-acetyl glucosamine transferase. In another embodiment, provided herein is a *Leishmania* host cell comprising (a) a recombinant nucleic acid encoding a target protein; and (b) a recombinant nucleic acid encoding a galactosyltransferase. In yet another embodiment, provided herein is a *Leishmania* host cell comprising (a) a recombinant nucleic acid encoding a target protein; and (b) a recombinant nucleic acid encoding a sialyltransferase. In a further embodiment, the host cell comprising a heterologous sialyltransferase further comprises a heterologous CMP-Sia biosynthetic pathway proteins capable of generating CMP-NeuAc.

In another embodiment, provided herein is a *Leishmania* host cell comprising (a) a recombinant nucleic acid encoding a target protein; (b) a recombinant nucleic acid encoding an N-acetyl glucosamine transferase; and (c) a recombinant nucleic acid encoding a galactosyltransferase. In another embodiment, provided herein is a *Leishmania* host cell comprising (a) a recombinant nucleic acid encoding a target protein; (b) a recombinant nucleic acid encoding an N-acetyl glucosamine transferase; and (c) a recombinant nucleic acid encoding a sialyltransferase. In yet another embodiment, provided herein is a *Leishmania* host cell comprising (a) a recombinant nucleic acid encoding a target protein; (b) a recombinant nucleic acid encoding a sialyltransferase; and (c) a recombinant nucleic acid encoding a galactosyltransferase. In a further embodiment, the host cell comprising a heterologous sialyltransferase further comprises a heterologous CMP-Sia biosynthetic pathway proteins capable of generating CMP-NeuAc.

In another embodiment, provided herein is a *Leishmania* host cell comprising (a) a recombinant nucleic acid encoding a target protein; (b) a recombinant nucleic acid encoding an N-acetyl glucosamine transferase; (c) a recombinant nucleic acid encoding a galactosyltransferase; and (d) a recombinant nucleic acid encoding a sialyltransferase. In a further embodiment, the host cell comprising a heterologous sialyltransferase further comprises a heterologous CMP-Sia biosynthetic pathway proteins capable of generating CMP-NeuAc.

In another embodiment, provided herein is a *Leishmania tarentolae* host cell comprising (a) a recombinant nucleic acid encoding a target protein; and (b) a recombinant nucleic acid encoding an N-acetyl glucosamine transferase. In another embodiment, provided herein is a *Leishmania* host cell comprising (a) a recombinant nucleic acid encoding a target protein; and (b) a recombinant nucleic acid encoding a galactosyltransferase. In yet another embodiment, provided herein is a *Leishmania* host cell comprising (a) a recombinant nucleic acid encoding a target protein; and (b) a recombinant nucleic acid encoding a sialyltransferase. In a further embodiment, the host cell comprising a heterologous sialyltransferase further comprises a heterologous CMP-Sia biosynthetic pathway proteins capable of generating CMP-NeuAc.

In another embodiment, provided herein is a *Leishmania tarentolae* host cell comprising (a) a recombinant nucleic acid encoding a target protein; (b) a recombinant nucleic acid encoding an N-acetyl glucosamine transferase; and (c) a recombinant nucleic acid encoding a galactosyltransferase. In another embodiment, provided herein is a *Leishmania* host cell comprising (a) a recombinant nucleic acid encoding a target protein; (b) a recombinant nucleic acid encoding an N-acetyl glucosamine transferase; and (c) a recombinant nucleic acid encoding a sialyltransferase. In yet another embodiment, provided herein is a *Leishmania* host cell comprising (a) a recombinant nucleic acid encoding a target protein; (b) a recombinant nucleic acid encoding a sialyltransferase; and (c) a recombinant nucleic acid encoding a galactosyltransferase. In a further embodiment, the host cell comprising a heterologous sialyltransferase further comprises a heterologous CMP-Sia biosynthetic pathway proteins capable of generating CMP-NeuAc.

In another embodiment, provided herein is a *Leishmania* host cell comprising (a) a recombinant nucleic acid encoding a target protein; (b) a recombinant nucleic acid encoding an N-acetyl glucosamine transferase; (c) a recombinant nucleic acid encoding a galactosyltransferase; and (d) a recombinant nucleic acid encoding a sialyltransferase. In a further embodiment, the host cell comprising a heterologous sialyltransferase further comprises a heterologous CMP-Sia biosynthetic pathway proteins capable of generating CMP-NeuAc.

In certain embodiments, the term "heterologous" means from a different species. For example, a "heterologous glycosyltransferase" in a host cell, is a glycosyltransferase derived from a species other than the host cell. In certain embodiments, the term "heterologous" means from a different strain. For example, a "heterologous glycosyltransferase" in a host cell, is a glycosyltransferase derived from a strain other than the host cell. In more specific embodiments, the term "heterologous" means from a different genus. For example, a "heterologous glycosyltransferase" in a host cell, is a glycosyltransferase derived from a genus other than the host cell.

In certain embodiments, a glycosyltransferase used with the methods and compositions provided herein is a glycosyltransferase that is genetically modified from its wild type gene. In more specific embodiments, such a glycosyltransferase is of the same species or of the same strain. In other embodiments, such a glycosyltransferase is of a different genus, species, or strain.

7.2 Subcellular Localization of Glycosyltransferases

In some embodiments, a *Leishmania* signal and retention sequence is added to the N-acetyl glucosamine transferase, galactosyltransferase, and/or sialyltransferase, wherein the signal sequence targets the N-acetyl glucosamine transferase, galactosyltransferase, and/or sialyltransferase to the endoplasmic reticulum of the *Leishmania* host cell, and wherein the retention sequence retains the N-acetyl glucosamine transferase, galactosyltransferase, and/or sialyltransferase in the endoplasmic reticulum or Golgi apparatus. In some embodiments, a *Leishmania* signal and retention sequence is added to the N-acetyl glucosamine transferase and sialyltransferase, wherein the signal sequence targets the N-acetyl glucosamine transferase and sialyltransferase to the endoplasmic reticulum of the *Leishmania* host cell, and wherein the retention sequence retains the N-acetyl glucosamine transferase and sialyltransferase in the endoplasmic reticulum or Golgi apparatus. In some embodiments, a *Leishmania* signal and retention sequence is added to the N-acetyl glucosamine transferase and galactosyltransferase, wherein the signal sequence targets the N-acetyl glucosamine transferase and galactosyltransferase to the endoplasmic reticulum of the *Leishmania* host cell, and wherein the retention sequence retains the N-acetyl glucosamine transferase and galactosyltransferase in the endoplasmic reticulum or Golgi apparatus. In some embodiments, a *Leishmania* signal and retention sequence is added to the sialyltransferase and galactosyltransferase, wherein the signal sequence targets the sialyltransferase and galactosyltransferase to the endoplasmic reticulum of the *Leishmania* host cell, and wherein the retention sequence retains the sialyltransferase and galactosyltransferase in the endoplasmic reticulum or Golgi apparatus.

In other embodiments, a *Leishmania* signal and retention sequence is added to the N-acetyl glucosamine transferase, wherein the signal sequence targets the N-acetyl glucosamine transferase to the endoplasmic reticulum of the *Leishmania* host cell, and wherein the retention sequence retains the N-acetyl glucosamine transferase, in the endoplasmic reticulum or Golgi apparatus. In other embodiments, a *Leishmania* signal and retention sequence is fused to the N-terminal of the N-acetyl glucosamine transferase. In another embodiment, a *Leishmania* signal and retention sequence is fused to the C-terminal of the N-acetyl glucosamine transferase. In a further embodiment, a *Leishmania* signal and retention sequence is not fused to the N-terminal of the N-acetyl glucosamine transferase. In other embodiments, a *Leishmania* signal and retention sequence is not fused to the C-terminal of the N-acetyl glucosamine transferase. In other embodiments, a *Leishmania* signal and retention sequence is fused to one or more amino acids within the polypeptide of the N-acetyl glucosamine transferase.

In other embodiments, a *Leishmania* signal and retention sequence is added to the galactosyltransferase, wherein the signal sequence targets the galactosyltransferase to the endoplasmic reticulum of the *Leishmania* host cell, and wherein the retention sequence retains the galactosyltransferase, in the endoplasmic reticulum or Golgi apparatus. In other embodiments, a *Leishmania* signal and retention sequence is fused to the N-terminal of the galactosyltransferase. In another embodiment, a *Leishmania* signal and retention sequence is fused to the C-terminal of the galactosyltransferase. In a further embodiment, a *Leishmania* signal and retention sequence is not fused to the N-terminal of the galactosyltransferase. In other embodiments, a *Leishmania* signal and retention sequence is not fused to the C-terminal of the galactosyltransferase. In other embodiments, a *Leishmania* signal and retention sequence is fused to one or more amino acids within the polypeptide of the galactosyltransferase.

In other embodiments, a *Leishmania* signal and retention sequence is added to the sialyltransferase, wherein the signal sequence targets the sialyltransferase to the endoplasmic reticulum of the *Leishmania* host cell, and wherein the retention sequence retains the sialyltransferase, in the endoplasmic reticulum or Golgi apparatus. In other embodiments, a *Leishmania* signal and retention sequence is fused to the N-terminal of the sialyltransferase. In another embodiment, a *Leishmania* signal and retention sequence is fused to the C-terminal of the sialyltransferase. In a further embodiment, a *Leishmania* signal and retention sequence is not fused to the N-terminal of the sialyltransferase. In other embodiments, a *Leishmania* signal and retention sequence is not fused to the C-terminal of the sialyltransferase. In other embodiments, a *Leishmania* signal and retention sequence is fused to one or more amino acids within the polypeptide of the sialyltransferase.

In another embodiment, the retention sequence retains the N-acetyl glucosamine transferase and/or galactosyltransferase in the endoplasmic reticulum of the host cell. In another embodiment, the retention sequence retains the N-acetyl glucosamine transferase and/or galactosyltransferase in the cis Golgi compartment of the host cell. In another embodiment, the retention sequence retains the N-acetyl glucosamine transferase and/or galactosyltransferase in the medial Golgi compartment of the host cell. In another embodiment, the retention sequence retains the galactosyltransferase in the trans Golgi compartment of the host cell. In another embodiment, the retention sequence retains the sialyltransferase in the trans Golgi compartment of the host cell. In another embodiment, the retention sequence retains the sialyltransferase and galactosyltransferase in the trans Golgi compartment of the host cell.

In another embodiment, the signal sequence and/or retension sequence is a signal sequence or retention sequence derived from any *Leishmania* species. In further embodiments, the signal sequence and/or retention sequence is a signal sequence or retention sequence derived from *Leishmania tarentolae.*

In further embodiments, the retention sequence is a cytoplasmic-transmembrane-stem (CTS) sequence derived from a *Leishmania tarentolae* protein. In another embodiment, the CTS sequence is derived from *Leishmania tarentolae* MAN1, NTPDase 1, or NTPDase 2. In another embodiment, the CTS sequence comprises the sequence of SEQ ID NO: 24, SEQ ID NO: 25, or SEQ ID NO: 26 or functionally active fragments thereof.

In another embodiment, the CTS is derived from *Leishmania tarentolae* MAN1. In another embodiment, the CTS sequence comprises the sequence of SEQ ID NO: 24 or a functionally active fragment thereof. In further embodiments, the CTS sequence is at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical to the CTS is derived from *Leishmania tarentolae* MAN1. In another embodiment, the CTS sequence comprises a sequence that is at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical to the sequence of SEQ ID NO: 24 or a functionally active fragment thereof.

In another embodiment, the CTS is derived from *Leishmania tarentolae* NTPDase 1. In another embodiment, the CTS sequence comprises the sequence of SEQ ID NO: 25 or a functionally active fragment thereof. In further embodiments, the CTS sequence is at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical to the CTS is derived from *Leishmania tarentolae* NTPDase 1. In another embodiment, the CTS sequence comprises a sequence that is at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical to the sequence of SEQ ID NO: 25 or a functionally active fragment thereof.

In another embodiment, the CTS is derived from *Leishmania tarentolae* NTPDase 2. In another embodiment, the CTS sequence comprises the sequence of SEQ ID NO: 26 or a functionally active fragment thereof. In further embodiments, the CTS sequence is at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical to the CTS is derived from *Leishmania tarentolae* NTPDase 2. In another embodiment, the CTS sequence comprises a sequence that is at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical to the sequence of SEQ ID NO: 26 or a functionally active fragment thereof.

In further embodiments, the retention sequence comprises a GRIP sequence derived from *Leishmania* or functionally active fragments thereof. In another embodiment, the GRIP sequence comprises the sequence of SEQ ID NO: 27, or a functionally active fragment thereof. In further embodiments, the retention sequence is at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical to the GRIP sequence derived from *Leishmania* or functionally active fragments thereof. In another embodiment, the GRIP sequence comprises a sequence that is at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical to the sequence of SEQ ID NO: 27 or a functionally active fragment thereof.

In further embodiments, the retention sequence comprises a CTS sequence derived from a *Leishmania* protein, or a functionally active fragment thereof, and a GRIP sequence derived from *Leishmania* or a functionally active fragment thereof. In another embodiment, the retention sequence comprises a CTS sequence that is at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical to one derived from a *Leishmania* protein, or a functionally active fragment thereof, and a GRIP sequence that is at least about 70%, 71%, 72%, 73%, 74%, 75%, 76%, 77%, 78%, 79%, 80%, 8100, 82%, 83%, 84%, 85%, 86%, 87%, 88%, 89%, 90%, 91%, 92%, 93%, 94%, 95%, 96%, 97%, 98%, 99%, or 100% identical to one derived from *Leishmania* or a functionally active fragment thereof.

In another embodiment, the target protein has been engineered to comprise a signal sequence from *Leishmania*. In other embodiment, said signal sequence is a signal sequence from *Leishmania tarentolae*. In some embodiments, the signal sequence comprises the sequence of SEQ ID NO: 28, or SEQ ID NO: 29 or functionally active fragments thereof. In a specific embodiment, the signal sequence comprises the sequence of SEQ ID NO: 28 or a functionally active fragment thereof. In yet another embodiment, the signal sequence comprises a sequence that is at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical to the sequence of SEQ ID NO: 28 or a functionally active fragment thereof. In other embodiments, the signal sequence is processed and removed from the target protein.

7.3 N-Acetyl Glucosamine Transferases

In a particular embodiment, provided herein is a hybrid N-acetyl glucosamine transferase, wherein the hybrid N-acetyl glucosamine transferase comprises (a) catalytic domain of an N-acetyl glucosamine transferase that is not from *Leishmania*; and (b) amino acid sequence(s) responsible for localization and retention in the endoplasmic reticulum or in the Golgi compartment of *Leishmania*.

In certain embodiments, the hybrid N-acetyl glucosamine transferase is from *Leishmania tarentolae*.

In other embodiments, the hybrid N-acetyl glucosamine transferase has been engineered to comprise a signal sequence and at least one retention sequence, wherein the signal sequence targets the N-acetyl glucosamine transferase to the endoplasmic reticulum of the *Leishmania tarentolae* host cell, and wherein the retention sequence retains the N-acetyl glucosamine transferase in the endoplasmic reticulum or Golgi apparatus.

In another embodiment, the hybrid N-acetyl glucosamine transferase retains the N-acetyl glucosamine transferase in the endoplasmic reticulum. In another embodiment, the hybrid N-acetyl glucosamine transferase retains the N-acetyl glucosamine transferase in the cis Golgi apparatus. In another embodiment, the hybrid N-acetyl glucosamine transferase retains the N-acetyl glucosamine transferase in the medial Golgi apparatus.

In further embodiments, the retention sequence is a cytoplasmic-transmembrane-stem (CTS) sequence. In another embodiment, the CTS sequence comprises the amino acid sequence of MAN1, NTPDase 1, or NTPDase 2. In another embodiment, the CTS sequence comprises the sequence of SEQ ID NO: 24, SEQ ID NO: 25, or SEQ ID NO: 26 or functionally active fragments thereof. In another embodiment, the CTS comprises the amino acid sequence of MAN1. In another embodiment, the CTS sequence comprises the sequence of SEQ ID NO: 24 or functionally active fragments thereof. In further embodiments, the GRIP sequence comprises the amino acid sequence of SEQ ID NO: 27.

In another embodiment, the N-acetyl glucosamine transferase is a GnT-I. In another embodiment, the N-acetyl glucosamine transferase is a GnT-II. In another embodiment, the N-acetyl glucosamine transferases are GnT-I and GnT-II. In certain other embodiments, the N-acetyl glucosamine transferase is derived from an N-acetyl glucosamine transferase listed in Table 9, or a functional homologue, isoform or variant thereof. Any N-acetyl glucosamine transferase, or nucleic acid encoding it, known in the art can be used in accordance with the host cells and methods described herein.

In a specific embodiment, the said N-acetyl glucosamine transferase is N-acetylglucosaminyltransferase 1 of *Homo sapiens*. In another embodiment, the said N-acetyl glucosamine transferase is mannosyl (alpha-1,6-)-glycoprotein beta-1,2-N-acetylglucosaminyltransferase of *Homo sapiens*. In certain embodiments, the N-acetyl glucosamine transferase is one that is homologous to a N-acetyl glucosamine transferase of a species of *Homo sapiens*. For example, the N-acetyl glucosamine transferase or a nucleic acid encoding it, is about 70%, 75%, 80%, 85%, 90%, 95%, 96%, 97%, 98%, or 99% homologous to N-acetylglucosaminyltransferase 1 or mannosyl (alpha-1,6-)-glycoprotein beta-1,2-N-acetylglucosaminyltransferase of *Homo sapiens*.

In a specific embodiment, the said N-acetyl glucosamine transferase is N-acetylglucosaminyltransferase 1 of Spodopterafrugiperda. In another embodiment, the said N-acetyl glucosamine transferase is N-acetylglucosaminyltransferase 2 of *Spodoptera frugiperda*. In certain embodiments, the N-acetyl glucosamine transferase is one that is homologous to a N-acetyl glucosamine transferase of a species of Spodopterafrugiperda. For example, the N-acetyl glucosamine transferase or a nucleic acid encoding it, is about 70%, 75%, 80%, 85%, 90%, 95%, 96%, 97%, 98%, or 99% homologous to N-acetylglucosaminyltransferase 1 or N-acetylglucosaminyltransferase 2 of *Spodoptera frugiperda*.

In a specific embodiment, the said N-acetyl glucosamine transferase is N-acetylglucosaminyltransferase 1 of *Trypanosoma brucei*. In another embodiment, the said N-acetyl glucosamine transferase is N-acetylglucosaminyltransferase 2 of *Trypanosoma brucei*. In certain embodiments, the N-acetyl glucosamine transferase is one that is homologous to a N-acetyl glucosamine transferase of a species of *Trypanosoma brucei*. For example, the N-acetyl glucosamine transferase or a nucleic acid encoding it, is about 70%, 75%, 80%, 85%, 90%, 95%, 96%, 97%, 98%, or 99% homologous to N-acetylglucosaminyltransferase 1 or N-acetylglucosaminyltransferase 2 of *Trypanosoma brucei*.

In a specific embodiment, the said N-acetyl glucosamine transferase is N-acetylglucosaminyltransferase 2 of *Rattus norvegicus*. In certain embodiments, the N-acetyl glucosamine transferase is one that is homologous to a N-acetyl glucosamine transferase of a species of *Rattus norvegicus*. For example, the N-acetyl glucosamine transferase or a nucleic acid encoding it, is about 70%, 75%, 80%, 85%, 90%, 95%, 96%, 97%, 98%, or 99% homologous to N-acetylglucosaminyltransferase 2 of *Rattus norvegicus*.

In a specific embodiment, the said N-acetyl glucosamine transferase is mannosyl (alpha-1,6-)-glycoprotein beta-1,2-N-acetylglucosaminyltransferase of *Pan paniscus*. In certain embodiments, the N-acetyl glucosamine transferase is one that is homologous to a N-acetyl glucosamine transferase of a species of *Pan paniscus*. For example, the N-acetyl glucosamine transferase or a nucleic acid encoding it, is about 70%, 75%, 80%, 85%, 90%, 95%, 96%, 97%, 98%, or 99% homologous to mannosyl (alpha-1,6-)-glycoprotein beta-1,2-N-acetylglucosaminyltransferase of *Pan paniscus*.

In a specific embodiment, the said N-acetyl glucosamine transferase is mannosyl (alpha-1,6-)-glycoprotein beta-1,2-N-acetylglucosaminyltransferase of *Canis lupus familiaris*. In certain embodiments, the N-acetyl glucosamine transferase is one that is homologous to a N-acetyl glucosamine transferase of a species of *Canis lupus familiaris*. For example, the N-acetyl glucosamine transferase or a nucleic acid encoding it, is about 70%, 75%, 80%, 85%, 90%, 95%, 96%, 97%, 98%, or 99% homologous to mannosyl (alpha-1,6-)-glycoprotein beta-1,2-N-acetylglucosaminyltransferase of *Canis lupus familiaris*.

In a specific embodiment, the said N-acetyl glucosamine transferase is mannosyl (alpha-1,6-)-glycoprotein beta-1,2-N-acetylglucosaminyltransferase of *Bos taurus*. In certain embodiments, the N-acetyl glucosamine transferase is one that is homologous to a N-acetyl glucosamine transferase of a species of *Bos taurus*. For example, the N-acetyl glucosamine transferase or a nucleic acid encoding it, is about 70%, 75%, 80%, 85%, 90%, 95%, 96%, 97%, 98%, or 99% homologous to mannosyl (alpha-1,6-)-glycoprotein beta-1,2-N-acetylglucosaminyltransferase of *Bos taurus*.

In a specific embodiment, the said N-acetyl glucosamine transferase is mannoside acetylglucosaminyltransferase 2 of *Mus musculus*. In certain embodiments, the N-acetyl glucosamine transferase is one that is homologous to a N-acetyl glucosamine transferase of a species of *Mus musculus*. For example, the N-acetyl glucosamine transferase or a nucleic acid encoding it, is about 70%, 75%, 80%, 85%, 90%, 95%, 96%, 97%, 98%, or 99% homologous to mannoside acetylglucosaminyltransferase 2 of *Mus musculus*.

In a specific embodiment, the said N-acetyl glucosamine transferase is mannosyl (alpha-1,6-)-glycoprotein beta-1,2-N-acetylglucosaminyltransferase of *Rattus norvegicus*. In certain embodiments, the N-acetyl glucosamine transferase is one that is homologous to a N-acetyl glucosamine transferase of a species of *Rattus norvegicus*. For example, the N-acetyl glucosamine transferase or a nucleic acid encoding it, is about 70%, 75%, 80%, 85%, 90%, 95%, 96%, 97%, 98%, or 99% homologous to mannosyl (alpha-1,6-)-glycoprotein beta-1,2-N-acetylglucosaminyltransferase of *Rattus norvegicus*.

In a specific embodiment, the said N-acetyl glucosamine transferase is mannosyl (alpha-1,6-)-glycoprotein beta-1,2-N-acetylglucosaminyltransferase of *Gallus gallus*. In certain embodiments, the N-acetyl glucosamine transferase is one that is homologous to a N-acetyl glucosamine transferase of a species of *Gallus gallus*. For example, the N-acetyl glucosamine transferase or a nucleic acid encoding it, is about 70%, 75%, 80%, 85%, 90%, 95%, 96%, 97%, 98%, or 99% homologous to mannosyl (alpha-1,6-)-glycoprotein beta-1,2-N-acetylglucosaminyltransferase of *Gallus gallus*.

In a specific embodiment, the said N-acetyl glucosamine transferase is mannosyl (alpha-1,6-)-glycoprotein beta-1,2-N-acetylglucosaminyltransferase of *Xenopus tropicalis*. In certain embodiments, the N-acetyl glucosamine transferase is one that is homologous to a N-acetyl glucosamine transferase of a species of *Xenopus tropicalis*. For example, the N-acetyl glucosamine transferase or a nucleic acid encoding it, is about 70%, 75%, 80%, 85%, 90%, 95%, 96%, 97%, 98%, or 99% homologous to mannosyl (alpha-1,6-)-glycoprotein beta-1,2-N-acetylglucosaminyltransferase of *Xenopus* tropicalis.

In a specific embodiment, the said N-acetyl glucosamine transferase is mannosyl (alpha-1,6-)-glycoprotein beta-1,2-N-acetylglucosaminyltransferase of *Danio rerio*. In certain embodiments, the N-acetyl glucosamine transferase is one that is homologous to a N-acetyl glucosamine transferase of a species of *Danio rerio*. For example, the N-acetyl glucosamine transferase or a nucleic acid encoding it, is about 70%, 75%, 80%, 85%, 90%, 95%, 96%, 97%, 98%, or 99% homologous to mannosyl (alpha-1,6-)-glycoprotein beta-1,2-N-acetylglucosaminyltransferase of *Danio rerio*.

In a certain embodiment, the said N-acetyl glucosamine transferase is AgaP_AGAP004397 (GI: 1274542) of *Anopheles gambiae*. In certain embodiments, the N-acetyl glucosamine transferase is one that is homologous to a N-acetyl glucosamine transferase of a species of *Anopheles gambiae*. For example, the N-acetyl glucosamine transferase or a nucleic acid encoding it, is about 70%, 75%, 80%, 85%, 90%, 95%, 96%, 97%, 98%, or 99% homologous to AgaP_AGAP004397 (GI: 1274542) of *Anopheles gambiae*.

In a certain embodiment, the said N-acetyl glucosamine transferase is AgaP_AGAP004397 (GI: 1274542) of *Caenorhabditis elegans*. In certain embodiments, the N-acetyl glucosamine transferase is one that is homologous to a N-acetyl glucosamine transferase of a species of *Anopheles gambiae*. For example, the N-acetyl glucosamine transferase or a nucleic acid encoding it, is about 70%, 75%, 80%, 85%, 90%, 95%, 96%, 97%, 98%, or 99% homologous to AgaP_AGAP004397 (GI: 1274542) of *Anopheles gambiae*.

In a certain embodiment, the said N-acetyl glucosamine transferase is gly-20 (GI: 179562) of *Caenorhabditis elegans*. In certain embodiments, the N-acetyl glucosamine transferase is one that is homologous to a N-acetyl glucosamine transferase of a species of *Caenorhabditis elegans*. For example, the N-acetyl glucosamine transferase or a nucleic acid encoding it, is about 70%, 75%, 80%, 85%, 90%, 95%, 96%, 97%, 98%, or 99% homologous to gly-20 (GI: 179562) of *Caenorhabditis elegans*.

In a certain embodiment, the said N-acetyl glucosamine transferase is beta-1,2-N-acetylglucosaminyltransferase II of *Arabidopsis thaliana*. In certain embodiments, the N-acetyl glucosamine transferase is one that is homologous to a N-acetyl glucosamine transferase of a species of *Arabidopsis thaliana*. For example, the N-acetyl glucosamine transferase or a nucleic acid encoding it, is about 70%, 75%, 80%, 85%, 90%, 95%, 96%, 97%, 98%, or 99% homologous to gly beta-1,2-N-acetylglucosaminyltransferase II of *Arabidopsis thaliana*.

In a certain embodiment, the said N-acetyl glucosamine transferase is gly-20 (GI: 179562) of *Caenorhabditis elegans*. In certain embodiments, the N-acetyl glucosamine transferase is one that is homologous to a N-acetyl glucosamine transferase of a species of *Caenorhabditis elegans*. For example, the N-acetyl glucosamine transferase or a nucleic acid encoding it, is about 70%, 75%, 80%, 85%, 90%, 95%, 96%, 97%, 98%, or 99% homologous to gly-20 (GI: 179562) of *Caenorhabditis elegans*.

In a certain embodiment, the said N-acetyl glucosamine transferase is the predicted alpha-1,3-mannosyl-glycoprotein 2-beta-N-acetylglucosaminyltransferase (XP_015280466.1) of *Gekko japonicus*. In certain embodiments, the N-acetyl glucosamine transferase is one that is homologous to a N-acetyl glucosamine transferase of a species of *Gekko japonicus*. For example, the N-acetyl glucosamine transferase or a nucleic acid encoding it, is about 70%, 75%, 80%, 85%, 90%, 95%, 96%, 97%, 98%, or 99% homologous to XP_015280466.1 of *Gekko japonicus*.

In other embodiments, provided herein is a nucleic acid encoding the hybrid N-acetyl glucosamine transferase.

7.4 Galactosyltransferases

In a specific embodiment, provided herein is a hybrid galactosyltransferase, wherein the hybrid galactosyltransferase comprises (a) catalytic domain of an galactosyltransferase that is not from *Leishmania*; and (b) amino acid sequence(s) responsible for localization and retention in the endoplasmic reticulum or Golgi compartment of *Leishmania.*

In another embodiment, the hybrid galactosyltransferase is from *Leishmania tarentolae.*

In further embodiments, the hybrid galactosyltransferase has been engineered to comprise a signal sequence, wherein the signal sequence targets the galactosyltransferase to the endoplasmic reticulum of the *Leishmania tarentolae* host cell, and wherein the retention sequence retains the galactosyltransferase in the endoplasmic reticulum or Golgi apparatus.

In certain embodiments, the hybrid galactosyltransferase retains the galactosyltransferase in the endoplasmic reticulum. In certain embodiments, the hybrid galactosyltransferase retains the galactosyltransferase in the cis Golgi apparatus. In another embodiment, the hybrid galactosyltransferase retains the galactosyltransferase in the medial Golgi apparatus. In another embodiment, the hybrid galactosyltransferase retains the galactosyltransferase in the trans Golgi apparatus.

In other embodiments, the retention sequence is a cytoplasmic-transmembrane-stem (CTS) sequence. In further embodiments, the hybrid galactosyltransferase is a GRIP sequence. In certain embodiments, the hybrid galactosyltransferase is a CTS sequence and a GRIP sequence. In another embodiment, the CTS sequence comprises the amino acid sequence of MAN1, NTPDase 1, or NTPDase 2. In another embodiment, the CTS sequence comprises the sequence of SEQ ID NO: 24, SEQ ID NO: 25, or SEQ ID NO: 26 or functionally active fragments thereof. In another embodiment, the CTS comprises the amino acid sequence of MAN1. In another embodiment, the CTS sequence comprises the sequence of SEQ ID NO: 24 or functionally active fragments thereof. In further embodiments, the GRIP sequence comprises the amino acid sequence of SEQ ID NO: 27.

In other embodiments, the galactosyltransferase is derived from an galactosyltransferase listed in Table 9, or a functional homologue, isoform or variant thereof. Any galactosyltransferase, or nucleic acid encoding it, known in the art can be used in accordance with the host cells and methods described herein.

In a specific embodiment, the said galactosyltransferase is Beta-1,4-galactosyltransferase 1 (B4GALT1) of *Homo sapiens*. In certain embodiments, the galactosyltransferase is one that is homologous to a galactosyltransferase of a species of *Homo sapiens*. For example, the galactosyltransferase or a nucleic acid encoding it, is about 70%, 75%, 80%, 85%, 90%, 95%, 96%, 97%, 98%, or 99% homologous to Beta-1,4-galactosyltransferase 1 of *Homo sapiens.*

In a specific embodiment, the said galactosyltransferase is Beta-1,4-galactosyltransferase 1 of *Pan* troglodytes. In certain embodiments, the galactosyltransferase is one that is homologous to a galactosyltransferase of a species of *Pan* troglodytes. For example, the galactosyltransferase or a nucleic acid encoding it, is about 70%, 75%, 80%, 85%, 90%, 95%, 96%, 97%, 98%, or 99% homologous to Beta-1,4-galactosyltransferase 1 of *Pan* troglodytes.

In a specific embodiment, the said galactosyltransferase is Beta-1,4-galactosyltransferase 1 of *Macaca mulatta*. In certain embodiments, the galactosyltransferase is one that is homologous to a galactosyltransferase of a species of *Macaca mulatta*. For example, the galactosyltransferase or a nucleic acid encoding it, is about 70%, 75%, 80%, 85%, 90%, 95%, 96%, 97%, 98%, or 99% homologous to Beta-1,4-galactosyltransferase 1 of *Macaca mulatta.*

In a specific embodiment, the said galactosyltransferase is Beta-1,4-galactosyltransferase 1 of *Canis lupus familiaris*. In certain embodiments, the galactosyltransferase is one that is homologous to a galactosyltransferase of a species of *Canis lupus familiaris*. For example, the galactosyltransferase or a nucleic acid encoding it, is about 70%, 75%, 80%, 85%, 90%, 95%, 96%, 97%, 98%, or 99% homologous to Beta-1,4-galactosyltransferase 1 of *Canis lupus familiaris.*

In a specific embodiment, the said galactosyltransferase is Beta-1,4-galactosyltransferase 1 of *Bos taurus*. In certain embodiments, the galactosyltransferase is one that is homologous to a galactosyltransferase of a species of *Bos taurus*. For example, the galactosyltransferase or a nucleic acid encoding it, is about 70%, 75%, 80%, 85%, 90%, 95%, 96%, 97%, 98%, or 99% homologous to Beta-1,4-galactosyltransferase 1 of *Bos taurus.*

In a specific embodiment, the said galactosyltransferase is Beta-1,4-galactosyltransferase 1 of *Mus musculus*. In certain embodiments, the galactosyltransferase is one that is homologous to a galactosyltransferase of a species of *Mus musculus*. For example, the galactosyltransferase or a nucleic acid encoding it, is about 70%, 75%, 80%, 85%, 90%, 95%, 96%, 97%, 98%, or 99% homologous to Beta-1,4-galactosyltransferase 1 of *Mus musculus.*

In a specific embodiment, the said galactosyltransferase is Beta-1,4-galactosyltransferase 1 of *Rattus norvegicus*. In certain embodiments, the galactosyltransferase is one that is homologous to a galactosyltransferase of a species of *Rattus norvegicus*. For example, the galactosyltransferase or a nucleic acid encoding it, is about 70%, 75%, 80%, 85%, 90%, 95%, 96%, 97%, 98%, or 99% homologous to Beta-1,4-galactosyltransferase 1 of *Rattus norvegicus.*

In a specific embodiment, the said galactosyltransferase is Beta-1,4-galactosyltransferase 1 of *Gallus gallus*. In certain embodiments, the galactosyltransferase is one that is homologous to a galactosyltransferase of a species of *Gallus gallus*. For example, the galactosyltransferase or a nucleic acid encoding it, is about 70%, 75%, 80%, 85%, 90%, 95%, 96%, 97%, 98%, or 99% homologous to Beta-1,4-galactosyltransferase 1 of *Gallus gallus.*

In a specific embodiment, the said galactosyltransferase is Beta-1,4-galactosyltransferase 1 of *Xenopus tropicalis*. In certain embodiments, the galactosyltransferase is one that is homologous to a galactosyltransferase of a species of *Xenopus tropicalis*. For example, the galactosyltransferase or a nucleic acid encoding it, is about 70%, 75%, 80%, 85%, 90%, 95%, 96%, 97%, 98%, or 99% homologous to Beta-1,4-galactosyltransferase 1 of *Xenopus* tropicalis.

In a specific embodiment, the said galactosyltransferase is Beta-1,4-galactosyltransferase 1 of *Danio rerio*. In certain embodiments, the galactosyltransferase is one that is homologous to a galactosyltransferase of a species of *Danio rerio*. For example, the galactosyltransferase or a nucleic acid encoding it, is about 70%, 75%, 80%, 85%, 90%, 95%, 96%, 97%, 98%, or 99% homologous to Beta-1,4-galactosyltransferase 1 of *Danio rerio.*

In further embodiments, provided herein is a nucleic acid encoding the hybrid galactosyltransferase.

7.5 Sialyltransferases

In a specific embodiment, provided herein is a hybrid sialyltransferase, wherein the hybrid sialyltransferase comprises (a) catalytic domain of an sialyltransferase that is not from *Leishmania*; and (b) amino acid sequence(s) responsible for localization and retention in the endoplasmic reticulum or Golgi compartment of *Leishmania.*

In another embodiment, the hybrid sialyltransferase is from *Leishmania tarentolae.*

In certain embodiments, the hybrid sialyltransferase has been engineered to comprise a signal sequence, wherein the signal sequence targets the sialyltransferase to the endoplasmic reticulum of the *Leishmania tarentolae* host cell, and wherein the retention sequence retains the sialyltransferase in the endoplasmic reticulum or Golgi apparatus. In another embodiment, the hybrid sialyltransferase retains the sialyltransferase in the trans Golgi apparatus.

In another embodiment, the retention sequence is a CTS sequence. In further embodiments, the retention sequence is a GRIP sequence. In other embodiments, the retention sequence is a CTS sequence and a GRIP sequence. In another embodiment, the CTS sequence comprises the amino acid sequence of MAN1, NTPDase 1, or NTPDase 2. In another embodiment, the CTS sequence comprises the sequence of SEQ ID NO: 24, SEQ ID NO: 25, or SEQ ID NO: 26 or functionally active fragments thereof. In another embodiment, the CTS comprises the amino acid sequence of MAN1. In another embodiment, the CTS sequence comprises the sequence of SEQ ID NO: 24 or functionally active fragments thereof. In another embodiment, the GRIP sequence comprises the sequence of SEQ ID NO: 27, or a functionally active fragments thereof.

In another embodiment, the sialyltransferase is a 2,6-SiaT or a 2,3-SiaT. In certain other embodiments, the hybrid sialyltransferase is derived from a sialyltransferase listed in Table 9, or a functional homologue, isoform or variant thereof. Any sialyltransferase, or nucleic acid encoding it, capable of adding one or more sialic acid residues to the monosaccharide (e.g., galactose) linked to the N-glycan that is linked to the Asn residue (or other relevant residue) in an N-glycosylation consensus sequence, e.g., Asn-X-Ser(Thr), wherein X can be any amino acid except Pro, can be used in accordance with the methods described herein, e.g., can be incorporated in a host cell described herein. Any sialyltransferase, or nucleic acid encoding it, known in the art can be used in accordance with the host cells and methods described herein.

In a specific embodiment, said sialyltransferase is Beta-galactoside alpha-2,6-sialyltransferase 1 of *Homo sapiens*. In another specific embodiment, said sialyltransferase is Beta-galactoside alpha-2,3-sialyltransferase 4 of *Homo sapiens*. In certain embodiments, the sialyltransferase is one that is homologous to a sialyltransferase of *Homo sapiens*. For example, the sialyltransferase, or nucleic acid encoding it, is about 70%, 75%, 80%, 85%, 90%, 95%, 96%, 97%, 98%, or 99% homologous to Beta-galactoside alpha-2,6-sialyltransferase 1 or Beta-galactoside alpha-2,3-sialyltransferase 4 of *Homo sapiens.*

In a specific embodiment, said sialyltransferase is Beta-galactoside alpha-2,6-sialyltransferase 1 of *Mus musculus*. In another specific embodiment, said sialyltransferase is Beta-galactoside alpha-2,3-sialyltransferase 3 of *Mus musculus*. In certain embodiments, the sialyltransferase is one that is homologous to a sialyltransferase of *Mus musculus*. For example, the sialyltransferase, or nucleic acid encoding it, is about 70%, 75%, 80%, 85%, 90%, 95%, 96%, 97%, 98%, or 99% homologous to Beta-galactoside alpha-2,6-sialyltransferase 1 or Beta-galactoside alpha-2,3-sialyltransferase 3 of *Mus musculus.*

In a specific embodiment, the said sialyltransferase is Beta-galactoside alpha-2,6-sialyltransferase 1 of *Rattus norvegicus*. In certain embodiments, the sialyltransferase is one that is homologous to a sialyltransferase of a species of *Rattus norvegicus*. For example, the sialyltransferase or a nucleic acid encoding it, is about 70%, 75%, 80%, 85%, 90%, 95%, 96%, 97%, 98%, or 99% homologous to Beta-galactoside alpha-2,6-sialyltransferase 1 of *Rattus norvegicus.*

In a specific embodiment, the said sialyltransferase is alpha-2,3-sialyltransferase of *Campylobacter jejuni*. In certain embodiments, the sialyltransferase is one that is homologous to a sialyltransferase of a species of *Campylobacter jejuni*. For example, the sialyltransferase or a nucleic acid encoding it, is about 70%, 75%, 80%, 85%, 90%, 95%, 96%, 97%, 98%, or 99% homologous to alpha-2,3-sialyltransferase of *Campylobacter jejuni.*

In a specific embodiment, the said sialyltransferase is alpha-2,3/8-sialyltransferase of *Campylobacter jejuni*. In certain embodiments, the sialyltransferase is one that is homologous to a sialyltransferase of a species of *Campylobacter jejuni*. For example, the sialyltransferase or a nucleic acid encoding it, is about 70%, 75%, 80%, 85%, 90%, 95%, 96%, 97%, 98%, or 99% homologous to alpha-2,3/8-sialyltransferase of *Campylobacter jejuni.*

In a specific embodiment, the said sialyltransferase is an alpha-2,3/2,6-sialyltransferase of *Pasteurella multocida* (AAY89061.1). In certain embodiments, the sialyltransferase is one that is homologous to a sialyltransferase of a species of *Pasteurella multocida*. For example, the sialyltransferase or a nucleic acid encoding it, is about 70%, 75%, 80%, 85%, 90%, 95%, 96%, 97%, 98%, or 99% homologous to alpha-2,3/2,6-sialyltransferase of *Pasteurella multocida.*

In a specific embodiment, the said sialyltransferase is an alpha-2,6-sialyltransferase of *Photobacterium damselae* (BAA25316.1). In certain embodiments, the sialyltransferase is one that is homologous to a sialyltransferase of a species of *Photobacterium damselae*. For example, the sialyltransferase or a nucleic acid encoding it, is about 70%, 75%, 80%, 85%, 90%, 95%, 96%, 97%, 98%, or 99% homologous to alpha-2,6-sialyltransferase of *Photobacterium damselae.*

In a specific embodiment, the said sialyltransferase is an hypothetical alpha-2,6-sialyltransferase of *Photobacterium damselae* (WP_005298232.1). In certain embodiments, the sialyltransferase is one that is homologous to a sialyltransferase of a species of *Photobacterium damselae*. For example, the sialyltransferase or a nucleic acid encoding it, is about 70%, 75%, 80%, 85%, 90%, 95%, 96%, 97%, 98%, or 99% homologous to alpha-2,6-sialyltransferase of *Photobacterium damselae.*

In a specific embodiment, the said sialyltransferase is an hypothetical alpha-2,6-sialyltransferase of *Photobacterium leiognathi* (BAF91416.1). In certain embodiments, the sialyltransferase is one that is homologous to a sialyltransferase of a species of *Photobacterium leiognathi*. For example, the sialyltransferase or a nucleic acid encoding it, is about 70%, 75%, 80%, 85%, 90%, 95%, 96%, 97%, 98%, or 99% homologous to alpha-2,6-sialyltransferase of *Photobacterium leiognathi.*

In a specific embodiment, the said sialyltransferase is an hypothetical alpha-2,6-sialyltransferase of *Photobacterium leiognathi* (BAI49484.1). In certain embodiments, the sialyltransferase is one that is homologous to a sialyltransferase of a species of *Photobacterium leiognathi*. For example, the sialyltransferase or a nucleic acid encoding it, is about 70%, 75%, 80%, 85%, 90%, 95%, 96%, 97%, 98%, or 99% homologous to alpha-2,6-sialyltransferase of *Photobacterium leiognathi.*

In a specific embodiment, the said sialyltransferase is an hypothetical alpha-2,6-sialyltransferase of *Photobacterium* sp. (BAF92026.1). In certain embodiments, the sialyltransferase is one that is homologous to a sialyltransferase of a species of *Photobacterium* sp. For example, the sialyltransferase or a nucleic acid encoding it, is about 70%, 75%, 80%, 85%, 90%, 95%, 96%, 97%, 98%, or 99% homologous to alpha-2,6-sialyltransferase of *Photobacterium* sp.

In certain embodiments, provided herein is a nucleic acid encoding the hybrid sialyltransferase.

7.6 CMP-Sia Biosynthetic Pathway

In other embodiments, the host cell comprising a heterologous sialyltransferase further comprises a heterologous CMP-Sia biosynthetic pathway proteins capable of generating CMP-NeuAc.

In further embodiments, the CMP-Sia biosynthetic pathway proteins capable of generating CMP-NeuAc are at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical to CMP-Sia biosynthetic pathway proteins listed in Table 11 or any functional homologue, isoform or variant thereof. Any sialic acid biosynthesis enzyme, or nucleic acid encoding it, known in the art can be used in accordance with the host cells and methods described herein.

In a specific embodiment, the said sialic acid biosynthesis enzyme is UDP-GlcNAc 2-epimerase/N-acetylmannosamine kinase of *Mus musculus*. In another embodiment, the said sialic acid biosynthesis enzyme is CMP-sialic acid transporter of *Mus musculus*. In certain embodiments, the sialic acid biosynthesis enzyme is one that is homologous to a sialic acid biosynthesis enzyme of a species of *Mus musculus*. For example, the sialic acid biosynthesis enzyme or a nucleic acid encoding it, is about 70%, 75%, 80%, 85%, 90%, 95%, 96%, 97%, 98%, or 99% homologous to UDP-GlcNAc 2-epimerase/N-acetylmannosamine kinase or CMP-sialic acid transporter of *Mus musculus*.

In a specific embodiment, the said sialic acid biosynthesis enzyme is UDP-N-GlcNAc 2-epimerase/N-acetylmannosamine kinase of *Homo sapiens*. In a specific embodiment, the said sialic acid biosynthesis enzyme is N-acetylneuraminic acid phosphate synthase of *Homo sapiens*. In another embodiment, the said sialic acid biosynthesis enzyme is Neu5Ac-9-P phosphatase of *Homo sapiens*. In a specific embodiment, the said sialic acid biosynthesis enzyme is CMP-sialic acid synthetase of *Homo sapiens*. In other embodiment, the said sialic acid biosynthesis enzyme is CMP-Neu5Ac transporter of *Homo sapiens*. In certain embodiments, the sialic acid biosynthesis enzyme is one that is homologous to a sialic acid biosynthesis enzyme of a species of *Homo sapiens*. For example, the sialic acid biosynthesis enzyme or a nucleic acid encoding it, is about 70%, 75%, 80%, 85%, 90%, 95%, 96%, 97%, 98%, or 99% homologous to UDP-N-GlcNAc 2-epimerase/N-acetylmannosamine kinase, N-acetylneuraminic acid phosphate synthase, Neu5Ac-9-P phosphatase, CMP-sialic acid synthetase, or CMP-Neu5Ac transporter of *Homo sapiens*.

In a specific embodiment, the said sialic acid biosynthesis enzyme is UDP-N-GlcNAc 2-epimerase/N-acetylmannosamine kinase of *Rattus norvegicus*. In certain embodiments, the sialic acid biosynthesis enzyme is one that is homologous to a sialic acid biosynthesis enzyme of a species of *Rattus norvegicus*. For example, the sialic acid biosynthesis enzyme or a nucleic acid encoding it, is about 70%, 75%, 80%, 85%, 90%, 95%, 96%, 97%, 98%, or 99% homologous to UDP-N-GlcNAc 2-epimerase/N-acetylmannosamine kinase of *Rattus norvegicus*. In other embodiments, the said UDP-N-GlcNAc 2-epimerase/N-acetylmannosamine kinase of *Rattus norvegicus* has point mutations from sialuria patient's GNE/MNK (Son et al 2011).

In a specific embodiment, the said sialic acid biosynthesis enzyme is CMP-sialic acid synthetase of *Neisseria meningitidis*. In another embodiment, the said sialic acid biosynthesis enzyme is UDP-N-acetylglucosamine 2-epimerase of *Neisseria meningitidis*. In a specific embodiment, the said sialic acid biosynthesis enzyme is CMP-sialic acid synthase of *Neisseria meningitidis*. In certain embodiments, the sialic acid biosynthesis enzyme is one that is homologous to a sialic acid biosynthesis enzyme of a species of *Neisseria meningitidis*. For example, the sialic acid biosynthesis enzyme or a nucleic acid encoding it, is about 70%, 75%, 80%, 85%, 90%, 95%, 96%, 97%, 98%, or 99% homologous to CMP-sialic acid synthetase, UDP-N-acetylglucosamine 2-epimerase or CMP-sialic acid synthase of *Neisseria meningitidis*.

In a specific embodiment, the said sialic acid biosynthesis enzyme is CMP-sialic acid synthetase of *Escherichia coli* K1. In another embodiment, the said sialic acid biosynthesis enzyme is UDP-N-acetylglucosamine 2-epimerase of *Escherichia coli* K1. In a specific embodiment, the said sialic acid biosynthesis enzyme is CMP-sialic acid synthase of *Escherichia coli* K1. In certain embodiments, the sialic acid biosynthesis enzyme is one that is homologous to a sialic acid biosynthesis enzyme of a species of *Escherichia coli* K1. For example, the sialic acid biosynthesis enzyme or a nucleic acid encoding it, is about 70%, 75%, 80%, 85%, 90%, 95%, 96%, 97%, 98%, or 99% homologous to CMP-sialic acid synthetase, UDP-N-acetylglucosamine 2-epimerase or CMP-sialic acid synthase of *Escherichia coli* K1.

In a specific embodiment, the said sialic acid biosynthesis enzyme is GNPE, a N-acetylglucosamine-6-phosphate 2'-epimerase of *Campylobacter jejuni* (CAM09378.1). In another embodiment, the said sialic acid biosynthesis enzyme is a N-acetylglucosamine-6-phosphate 2'-epimerase of *Campylobacter jejuni*. In a specific embodiment, the said sialic acid biosynthesis enzyme is a N-acetylglucosamine-6-phosphate 2'-epimerase synthase of *Campylobacter jejuni*. In certain embodiments, the sialic acid biosynthesis enzyme is one that is homologous to a sialic acid biosynthesis enzyme of a species of a N-acetylglucosamine-6-phosphate 2'-epimerase. For example, the sialic acid biosynthesis enzyme or a nucleic acid encoding it, is about 70%, 75%, 80%, 85%, 90%, 95%, 96%, 97%, 98%, or 99% homologous to N-acetylglucosamine-6-phosphate 2'-epimerase of *Campylobacter jejuni*.

In a specific embodiment, the said sialic acid biosynthesis enzyme is GNPE, a N-acetylglucosamine-6-phosphate 2'-epimerase of *Neisseria meningitidis* (AAY27727.1). In another embodiment, the said sialic acid biosynthesis enzyme is a N-acetylglucosamine-6-phosphate 2'-epimerase of *Neisseria meningitidis*. In a specific embodiment, the said sialic acid biosynthesis enzyme is a N-acetylglucosamine-6-phosphate 2'-epimerase synthase of *Neisseria meningitidis*. In certain embodiments, the sialic acid biosynthesis enzyme is one that is homologous to a sialic acid biosynthesis enzyme of a species of a N-acetylglucosamine-6-phosphate 2'-epimerase. For example, the sialic acid biosynthesis enzyme or a nucleic acid encoding it, is about 70%, 75%, 80%, 85%, 90%, 95%, 96%, 97%, 98%, or 99% homologous to N-acetylglucosamine-6-phosphate 2'-epimerase of *Neisseria meningitidis*.

In a specific embodiment, the said sialic acid biosynthesis enzyme is CgNal, a N-acetylneuraminic acid lyase of *Corynebacterium glutamicum* (NP_601846.1). In another embodiment, the said sialic acid biosynthesis enzyme is CgNal, a N-acetylneuraminic acid lyase of *Corynebacterium glutamicum*. In a specific embodiment, the said sialic acid biosynthesis enzyme is a CgNal, a N-acetylneuraminic acid lyase of *Corynebacterium glutamicum*. In certain embodiments, the sialic acid biosynthesis enzyme is one that is homologous to a sialic acid biosynthesis enzyme of a species of a CgNal, a N-acetylneuraminic acid lyase. For example, the sialic acid biosynthesis enzyme or a nucleic acid encoding it, is about 70%, 75%, 80%, 85%, 90%, 95%, 96%, 97%, 98%, or 99% homologous to CgNal, a N-acetylneuraminic acid lyase of *Corynebacterium glutamicum* (Ji et al. 2015).

7.7 *Leishmania* and Kinetoplastida Strains

As used herein, the host cell is a *Leishmania* cell. In certain embodiments, the host cell is a *Leishmania tarentolae* cell. In other embodiments, the host cell is a *Leishmania* strain from Table 13.

In certain embodiments, the host cell is a *Leishmania aethiopica* cell. In certain embodiments, the host cell is part of the *Leishmania aethiopica* species complex. In certain embodiments, the host cell is a *Leishmania* aristidesi cell. In certain embodiments, the host cell is a *Leishmania deanei* cell. In certain embodiments, the host cell is part of the *Leishmania donovani* species complex. In certain embodiments, the host cell is a *Leishmania donovani* cell. In certain embodiments, the host cell is a *Leishmania chagasi* cell. In certain embodiments, the host cell is a *Leishmania infantum* cell. In certain embodiments, the host cell is a *Leishmania hertigi* cell. In certain embodiments, the host cell is part of the *Leishmania major* species complex. In certain embodiments, the host cell is a *Leishmania major* cell. In certain embodiments, the host cell is a *Leishmania* martiniquensis cell. In certain embodiments, the host cell is part of the *Leishmania mexicana* species complex. In certain embodiments, the host cell is a *Leishmania mexicana* cell. In certain embodiments, the host cell is a *Leishmania pifanoi* cell. In certain embodiments, the host cell is part of the *Leishmania tropica* species complex. In certain embodiments, the host cell is a *Leishmania tropica* cell.

In certain embodiments, the host cell belongs to the bodonidae family of kinetoplasts. In a specific embodiment, the host cell is a Bodo saltans cell. In certain embodiments, the host cell belongs to the ichthyobodonidae family of kinetoplasts. In certain embodiments, the host cell belongs to the trypanosomatidae family of kinetoplasts.

In certain embodiments, the host cell belongs to the blastocrithidia family of trypanosomatidae. In certain embodiments, the host cell belongs to the blechomonas family of trypanosomatidae. In certain embodiments, the host cell belongs to the herpetomonas family of trypanosomatidae. In certain embodiments, the host cell belongs to the jaenimonas family of trypanosomatidae. In certain embodiments, the host cell belongs to the lafontella family of trypanosomatidae. In certain embodiments, the host cell belongs to the leishmaniinae family of trypanosomatidae. In certain embodiments, the host cell belongs to the novymonas family of trypanosomatidae. In certain embodiments, the host cell belongs to the paraTrypanosoma family of trypanosomatidae. In certain embodiments, the host cell belongs to the phytomonas family of trypanosomatidae. In certain embodiments, the host cell belongs to the sergeia family of trypanosomatidae. In certain embodiments, the host cell belongs to the strigomonadinae family of trypanosomatidae. In certain embodiments, the host cell belongs to the *Trypanosoma* family of trypanosomatidae. In certain embodiments, the host cell belongs to the wallacemonas family of trypanosomatidae. In certain embodiments, the host cell belongs to the blastocrithidia family of trypanosomatidae.

7.8 Further Engineered *Leishmania* Host Cells

In certain embodiments, the host cells used to herein are engineered to comprise heterologous nucleic acids, e.g., heterologous nucleic acids that encode one or more carrier proteins and/or heterologous nucleic acids that encode one or more proteins, e.g., genes encoding one or more proteins. In another specific embodiment, heterologous nucleic acids are introduced into the host cells described herein using the methods of insertion provided herein.

In certain embodiments, additional modifications may be introduced (e.g., using recombinant techniques) into the host cells described herein. For example, host cell nucleic acids (e.g., genes) that encode proteins that form part of a possibly competing or interfering glycosylation pathway (e.g., compete or interfere with one or more heterologous genes involved in glycosylation that are recombinantly introduced into the host cell) can be deleted or modified in the host cell background (genome) in a manner that makes them inactive/dysfunctional (i.e., the host cell nucleic acids that are deleted/modified do not encode a functional protein or do not encode a protein whatsoever). In certain embodiments, when nucleic acids are deleted from the genome of the host cells provided herein, they are replaced by a desirable sequence, e.g., a sequence that is useful for glycoprotein production. Such replacement can be by way of one or more of the methods of insertion described herein, wherein the heterologous insert DNA that is inserted into the host cell may replace the function of the gene(s) deleted from the host cell.

In certain embodiments, the host cells provided herein comprise a gene deletion, wherein a DNA sequence of interest has been inserted into the host cell genome at the site of the gene deletion. In a specific embodiment, a host cell provided herein is *Leishmania* bearing a gene deletion.

7.9 Introduction of Nucleic Acids into Host Cells

Any method known in the art can be used to introduce a nucleic acid (e.g., a gene fragment thereof) into the host cell, e.g., *Leishmania tarentolae.*

In certain embodiments, heterologous nucleic acids are introduced into the host cells described herein using a plasmid, e.g., the heterologous nucleic acids are expressed in the host cells by a plasmid (e.g., an expression vector), and the plasmid is introduced into the modified host cells by transfection, infection, or electroporation, chemical transformation by heat shock, natural transformation, phage transduction, or conjugation. In a specific embodiment, said plasmid is introduced into the modified host cells by stable transfection.

In specific embodiments, linearized heterologous nucleic acids are introduced into the host cells described herein using transfection, infection, or electroporation, chemical transformation by heat shock, natural transformation, phage transduction, or conjugation. In a further embodiment, heterologous nucleic acids are integrated site-specifically into the host cell genome by homologous recombination.

7.10 Methods of Glycosylated Target Protein Production

Provided herein are methods for producing N-glycosylated target proteins.

In one embodiment, provided herein is a method of producing glycosylated target proteins in vivo, using a host cell described herein. In a specific embodiment, provided herein is a method for producing glycosylated target proteins, said method comprising (i) culturing a host cell provided herein under conditions suitable for protein production and (ii) isolating said target protein. In a specific embodiment, the host cell comprises (a) a recombinant nucleic acid encoding a target protein; and (b) a recombinant nucleic acid encoding a heterologous glycosyltransferase. In certain embodiments, the heterologous glycosyltransferase is an N-acetyl glucosamine transferase; or a heterologous galactosyltransferase; or a heterologous sialyltransferase. In certain embodiments, the host cell is a *Leishmania* cell.

In certain embodiments, the target protein produced by the host cells provided is a therapeutic protein, i.e., a protein used in the treatment of a disease or disorder. For example, the target protein produced by the host cells provided herein can be an enzyme, a cytokine, or an antibody, wherein said target protein has been glycosylated, e.g., sialylated. A non-limiting list of target proteins is provided in Section 7.12, below.

7.11 Methods of Culturing Cells

Provided herein are methods for culturing host cells.

In one embodiment, host cells are cultured using any of the standard culturing techniques known in the art. For example, cells are routinely grown in rich media like Brain Heart Infusion, Trypticase Soy Broth or Yeast Extract, all containing 5 ug/ml Hemin. Additionally, incubation is done at 26° C. in the dark as static or shaking cultures for 2-3 d. In some embodiments, cultures of recombinant cell lines contain the appropriate selective agents. A non-limiting list of selective agents is provided in Table 9.

7.12 Target Proteins

Any protein (or peptide/polypeptide corresponding to the protein) known in the art can be used as a target protein in accordance with the methods described herein. One of skill in the art will readily appreciate that the nucleic acid sequence of a known protein, as well as a newly identified protein, can easily be deduced using methods known in the art, and thus it would be well within the capacity of one of skill in the art to introduce a nucleic acid that encodes any protein of interest into a host cell provided herein (e.g., via an expression vector, e.g., a plasmid, e.g., a site specific integration by homologous recombination).

In other embodiments, the target protein comprises the amino acid sequence of human Interferon-α (INF-α), Interferon-0 (INF-0), Interferon-7 (INF-7), Interleukin-2 (IL2), Chimeric diphteria toxin-IL-2 (Denileukin diftitox), Interleukin-1 (IL1), IL1B, IL3, IL4, IL11, IL21, IL22, IL1 receptor antagonist (anakinra), Tumor necrosis factor alpha (TNF-α), Insulin, Pramlintide, Growth hormone (GH), Insulin-like growth factor (IGF1), Human parathyroid hormone, Calcitonin, Glucagon-like peptide-1 agonist (GLP-1), Glucagon, Growth hormone-releasing hormone (GHRH), Secretin, Thyroid stimulating hormone (TSH), Human bone morphogenic protein 2 (hBMP2), Human bone morphogenic proetin 7 (hBMP7), Gonadotropin releasing hormone (GnRH), Keratinocyte growth factor (KGF), Platelet-derived growth factor (PDGF), Fibroblast growth factor 7 (FGF7), Fibroblast growth factor 20 (FGF20), Fibroblast growth factor 21 (FGF21), Epidermal growth factor (EGF), Vascular endothelial growth factor (VEGF), Neurotrophin-3, Human follicle-stimulating hormone (FSH), Human chorionic gonadotropin (HCG), Lutropin-α, Erythropoietin, Granulocyte colony-stimulating factor (G-CSF), Granulocyte-macrophage colony-stimulating factor (GM-CSF), the extracellular domain of CTLA4 (e.g., an FC-fusion), or the extracellular domain of TNF receptor (e.g., an FC-fusion).

In a specific embodiment, the target protein used in accordance with the methods and host cells described herein is an enzyme or an inhibitor. Exemplary enzymes and inhibitors that can be used as a target protein include, without limitation, Factor VII, Factor VIII, Factor IX, Factor X, Factor XIII, Factor VIIa, Antithrombin III (AT-III), Protein C, Tissue plasminogen activator (tPA) and tPA variants, Urokinase, Hirudin, Streptokinase, Glucocerebrosidase, Alglucosidase-α, Laronidase (α-L-iduronidase), Idursulphase (Iduronate-2-sulphatase), Galsulphase, Agalsidase-β (human α-galactosidase A), Botulinum toxin, Collagenase, Human DNAse-I, Hyaluronidase, Papain, L-Asparaginase, Uricase (Urate oxidase), glutamate carboxypeptidase (glucarpidase), α1 Protease inhibitor (α1 antitrypsin), Lactase, Pancreatic enzymes (lipase, amylase, protease), and Adenosine deaminase.

In a specific embodiment, the target protein used in accordance with the methods and host cells described herein is a cytokine. Exemplary cytokines that can be used as a target protein include, without limitation, Interferon-α (INF-α), Interferon-0 (INF-0), Interferon-7 (INF-7), Interleukin-2 (IL2), Chimeric diphteria toxin-IL-2 (Denileukin diftitox), Interleukin-1 (IL1), IL1B, IL3, IL4, IL11, IL21, IL22, IL1 receptor antagonist (anakinra), and Tumor necrosis factor alpha (TNF-α).

In a specific embodiment, the target protein used in accordance with the methods and host cells described herein is a hormone or growth factor. Exemplary hormones and growth factors that can be used as a target protein include, without limitation, Insulin, Pramlintide, Growth hormone (GH), Insulin-like growth factor (IGF1), Human parathyroid hormone, Calcitonin, Glucagon-like peptide-1 agonist (GLP-1), Glucagon, Growth hormone-releasing hormone (GHRH), Secretin, Thyroid stimulating hormone (TSH), Human bone morphogenic protein 2 (hBMP2), Human bone morphogenic proetin 7 (hBMP7), Gonadotropin releasing hormone (GnRH), Keratinocyte growth factor (KGF), Platelet-derived growth factor (PDGF), Fibroblast growth factor 7 (FGF7), Fibroblast growth factor 20 (FGF20), Fibroblast growth factor 21 (FGF21), Epidermal growth factor (EGF), Vascular endothelial growth factor (VEGF), Neurotrophin-3, Human follicle-stimulating hormone (FSH), Human chorionic gonadotropin (HCG), Lutropin-α, Erythropoietin, Granulocyte colony-stimulating factor (G-CSF), and Granulocyte-macrophage colony-stimulating factor (GM-CSF).

In a specific embodiment, the target protein used in accordance with the methods and host cells described herein is a receptor. Exemplary receptors that can be used as a target protein include, without limitation, the extracellular domain of human CTLA4 (e.g., fused to an Fc) and the soluble TNF receptor (e.g., fused to an Fc).

In other embodiments, the target protein is a therapeutic protein. In other embodiments, the target protein is an approved biologic drug. In another embodiment, the therapeutic protein comprises the amino acid sequence of Abatacept (e.g., Orencia), Aflibercept (e.g., Eylea), Agalsidase beta (e.g., Fabrazyme), Albiglutide (e.g., Eperzan), Aldesleukin (e.g., Proleukin), Alefacept (e.g., Amevive), Alglucerase (e.g., Ceredase), Alglucosidase alfa (e.g., LUMIZYME), Aliskiren (e.g., Tekturna), Alpha-1-proteinase inhibitor (e.g., Aralast), Alteplase (e.g., Activase), Anakinra (e.g., Kineret), Anistreplase (e.g., Eminase), Anthrax immune globulin human (e.g., ANTHRASIL), Antihemophilic Factor (e.g., Advate), Anti-inhibitor coagulant complex (e.g., Feiba Nf), Antithrombin Alfa, Antithrombin III human, Antithymocyte globulin (e.g., Antithymocyte globulin), Anti-thymocyte Globulin (Equine) (e.g., ATGAM), Anti-thymocyte Globulin (Rabbit) (e.g., ATG-Fresenius), Aprotinin (e.g., Trasylol), Asfotase Alfa, Asparaginase (e.g., Elspar), Asparaginase *Erwinia chrysanthemi* (e.g., Erwinaze), Becaplermin (e.g., REGRANEX), Belatacept (e.g., Nulojix), Beractant, Bivalirudin (e.g., Angiomax), Botulinum Toxin Type A (e.g., BOTOXE), Botulinum Toxin Type B (e.g., Myobloc), Brentuximab vedotin (e.g., Adcetris), Buserelin (e.g., Suprecur), C1 Esterase Inhibitor (Human), C1 Esterase Inhibitor (Recombinant) (e.g., Ruconest), Certolizumab pegol (e.g., Cimzia), Choriogonadotropin alfa (e.g., Choriogonadotropin alfa), Chorionic Gonadotropin (Human) (e.g., Ovidrel), Chorionic Gonadotropin (Recombinant) (e.g., Ovitrelle), Coagulation factor ix (e.g., Alprolix), Coagulation factor VIIa (e.g., NovoSeven), Coagulation factor X human (e.g., Coagadex), Coagulation Factor XIII A-Subunit (Recombinant), Collagenase (e.g., Cordase), Conestat alfa, Corticotropin (e.g., H.P. Acthar), Cosyntropin (e.g., Cortrosyn), Darbepoetin alfa (e.g., Aranesp), Defibrotide (e.g., Noravid), Denileukin diftitox (e.g., Ontak), Desirudin, Digoxin Immune Fab (Ovine) (e.g., DIGIBIND), Dornase alfa (e.g., Pulmozyme), Drotrecogin alfa (e.g., Xigris), Dulaglutide, Efmoroctocog alfa (e.g., ELOCTA), Elosulfase alfa, Enfuvirtide (e.g., FUZEON), Epoetin alfa (e.g., Binocrit), Epoetin zeta (e.g., Retacrit), Eptifibatide (e.g., INTEGRILIN), Etanercept (e.g., Enbrel), Exenatide (e.g., Byetta), Factor IX Complex (Human) (e.g., AlphaNine), Fibrinolysin aka plasmin (e.g., Elase), Filgrastim (e.g., N.A.), Filgrastim-sndz, Follitropin alfa (e.g., Gonal-F), Follitropin beta (e.g., Follistim AQ), Galsulfase (e.g., Naglazyme), Gastric intrinsic factor, Gemtuzumab ozogamicin (e.g., Mylotarg), Glatiramer acetate (e.g., Copaxone), Glucagon recombinant (e.g., GlucaGen), Glucarpidase (e.g., Voraxaze), Gramicidin D (e.g., Neosporin), Hepatitis B immune globulin, Human calcitonin, Human *Clostridium tetani* toxoid immune globulin, Human rabies virus immune globulin (e.g., Hyperab Rabies Immune Globulin Human), Human Rho(D) immune globulin (e.g., Hyp Rho D Inj 16.5%), Human Serum Albumin (e.g., Albuminar), Human Varicella-Zoster Immune Globulin (e.g., Varizig), Hyaluronidase (e.g., HYLENEX), Hyaluronidase (Human Recombinant), Ibritumomab tiuxetan (e.g., Zevalin), Idursulfase (e.g., Elaprase), Imiglucerase (e.g., Cerezyme), Immune Globulin Human, Insulin aspart (e.g., NovoLog), Insulin Beef, Insulin Degludec (e.g., Tresiba), Insulin detemir (e.g., LEVEMIR), Insulin Glargine (e.g., Lantus), Insulin glulisine (e.g., APIDRA), Insulin Lispro (e.g., Humalog), Insulin Pork (e.g., Iletin II), Insulin Regular (e.g., Humulin R), Insulin, porcine (e.g., vetsulin), Insulin, isophane (e.g., Novolin N), Interferon Alfa-2a, Recombinant (e.g., Roferon A), Interferon alfa-2b (e.g., INTRON A), Interferon alfacon-1 (e.g., INFERGEN), Interferon alfa-nl (e.g., Wellferon), Interferon alfa-n3 (e.g., Alferon), Interferon beta-1a (e.g., Avonex), Interferon beta-1b (e.g., Betaseron), Interferon gamma-1b (e.g., Actimmune), Intravenous Immunoglobulin (e.g., Civacir), Laronidase (e.g., Aldurazyme), Lenograstim (e.g., Granocyte), Lepirudin (e.g., Refludan), Leuprolide (e.g., Eligard), Liraglutide (e.g., Saxenda), Lucinactant (e.g., Surfaxin), Lutropin alfa (e.g., Luveris), Mecasermin (e.g., N.A.), Menotropins (e.g., Menopur), Methoxy polyethylene glycol-epoetin beta (e.g., Mircera), Metreleptin (e.g., Myalept), Natural alpha interferon OR multiferon (e.g., Intron/Roferon-A), Nesiritide (e.g., NATRECOR), Ocriplasmin (e.g., Jetrea), Oprelvekin (e.g., Neumega), OspA lipoprotein (e.g., Lymerix), Oxytocin (e.g., Pitocin), Palifermin (e.g., Kepivance), Pancrelipase (e.g., Pancrecarb), Pegademase bovine (e.g., Adagen), Pegaspargase (e.g., Oncaspar), Pegfilgrastim (e.g., Neulasta), Peginterferon alfa-2a (e.g., Pegasys), Peginterferon alfa-2b (e.g., PEG-Intron), Peginterferon beta-1a (e.g., Plegridy), Pegloticase (e.g., (Krystexxa)), Pegvisomant (e.g., SOMAVERT), Poractant alfa (e.g., Curosurf), Pramlintide (e.g., Symlin), Preotact (e.g., PreotactE), Protamine sulfate (e.g., Protamine Sulfate Injection, USP), Protein S human (e.g., Protein S human), Prothrombin (e.g., Feiba Nf), Prothrombin complex (e.g., Cofact), Prothrombin complex concentrate (e.g., Kcentra), Rasburicase (e.g., Elitek), Reteplase (e.g., Retavase), Rilonacept (e.g., Arcalyst), Romiplostim (e.g., Nplate), Sacrosidase (e.g., Sucraid), Salmon Calcitonin (e.g., Calcimar), Sargramostim (e.g., Leucomax), Satumomab Pendetide (e.g., OncoScint), Sebelipase alfa (e.g., Kanuma), Secretin (e.g., SecreFlo), Sermorelin (e.g., Sermorelin acetate), Serum albumin (e.g., Albunex), Serum albumin iodonated (e.g., Megatope), Simoctocog Alfa (e.g., Nuwiq), Sipuleucel-T (e.g., Provenge), Somatotropin Recombinant (e.g., NutropinAQ), Somatropin recombinant (e.g., BioTropin), Streptokinase (e.g., Streptase), Susoctocog alfa (e.g., Obizur), Taliglucerase alfa (e.g., Elelyso), Teduglutide (e.g., Gattex), Tenecteplase (e.g., TNKase), Teriparatide (e.g., Forteo), Tesamorelin (e.g., Egrifta), Thrombomodulin Alfa (e.g., Recomodulin), Thymalfasin (e.g., Zadaxin), Thyroglobulin, Thyrotropin Alfa (e.g., Thyrogen), Tuberculin Purified Protein Derivative (e.g., Aplisol), Turoctocog alfa (e.g., Zonovate), Urofollitropin (e.g., BRAVELLE), Urokinase (e.g., Kinlytic), Vasopressin (e.g., Pitressin), Velaglucerase alfa (e.g., Vpriv), Abciximab (e.g., ReoPro), Adalimumab (e.g., Humira), Alemtuzumab (e.g., CAMPATH), Alirocumab (e.g., Praluent), Arcitumomab (e.g., CEA-Scan), Atezolizumab (e.g., Tecentriq), Basiliximab (e.g., Simulect), Belimumab (e.g., Benlysta), Bevacizumab (e.g., Avastin), Blinatumomab (e.g., Blincyto), Brodalumab (e.g., Siliq), Canakinumab (e.g., ILARISE), Canakinumab (e.g., Ilaris), Capromab (e.g., ProstaScint), Cetuximab (e.g., Erbitux), Daclizumab (e.g., Zenapax), Daratumumab (e.g., DARZALEX), Denosumab (e.g., Xgeva), Dinutuximab (e.g., unituxin), Eculizumab (e.g., Soliris), Efalizumab (e.g., RAPTIVA), Elotuzumab (e.g., EMPLICITI), Evolocumab (e.g., Repatha), Golimumab (e.g., Simponi Injection), Ibritumomab (e.g., Zevalin), Idarucizumab (e.g., Praxbind), Infliximab (e.g., REMICADE), Ipilimumab (e.g., YERVOY), Ixekizumab (e.g., Taltz), Mepolizumab (e.g., Nucala), Muromonab (e.g., ORTHOCLONE OKT3), Natalizumab (e.g., Tysabri), Necitumumab (e.g., Portrazza), Nivolumab (e.g., Opdivo), Obiltoxaximab (e.g., Anthim), Obinutuzumab (e.g., Gazyva), Ofatumumab (e.g., Arzerra), Omalizumab (e.g., Xolair), Palivizumab (e.g., Synagis), Panitumumab (e.g., Vectibix), Pembrolizumab (e.g., Keytruda), Pertuzumab (e.g., Perjeta), Ramucirumab (e.g., Cyramza), Ranibizumab (e.g., Lucentis), Raxibacumab (e.g., RAXIBACUMAB), Rituximab (e.g., Rituxan), Secukinumab (e.g., Cosentyx), Siltuximab (e.g., Sylvant), Tocilizumab (e.g., ACTEMRA), Tositumomab (e.g., Bexxar), Trastuzumab (e.g., Herceptin), Ustekinumab (e.g., Stelara), or Vedolizumab (e.g., Entyvio).

In other embodiments, the target protein is an antibody. In another embodiment, the target protein is an antibody against a human protein.

In further embodiments, the antibody has the amino acid sequence of adalimumab (Humira); Remicade (Infliximab); ReoPro (Abciximab); Rituxan (Rituximab); Simulect (Basiliximab); Synagis (Palivizumab); Herceptin (Trastuzumab); Mylotarg (Gemtuzumab ozogamicin); Campath (Alemtuzumab); Zevalin (Ibritumomab tiuxetan); Xolair (Omalizumab); Bexxar (Tositumomab-I-131); Erbitux (Cetuximab); Avastin (Bevacizumab); Tysabri (Natalizumab); Actemra (Tocilizumab); Vectibix (Panitumumab); Lucentis (Ranibizumab); Soliris (Eculizumab); Cimzia (Certolizumab pegol); Simponi (Golimumab); Ilaris (Canakinumab); Stelara (Ustekinumab); Arzerra (Ofatumumab); Prolia (Denosumab); Numax (Motavizumab); ABThrax (Raxibacumab); Benlysta (Belimumab); Yervoy (Ipilimumab); Adcetris (Brentuximab Vedotin); Perjeta (Pertuzumab); Kadcyla (Ado-trastuzumab emtansine); or Gazyva (Obinutuzumab).

In other embodiments, the antibody is a full length antibody, an Fab, an F(ab')2, an Scfv, or a sdAb. In other embodiments, the target protein comprises the amino acid sequence of an enzyme or an inhibitor thereof. In another embodiment, the target protein comprises the amino acid sequence of Factor VII, Factor VIII, Factor IX, Factor X, Factor XIII, Factor VIIa, Antithrombin III (AT-III), Protein C, Tissue plasminogen activator (tPA) and tPA variants, Urokinase, Hirudin, Streptokinase, Glucocerebrosidase, Alglucosidase-α, Laronidase (α-L-iduronidase), Idursulphase (Iduronate-2-sulphatase), Galsulphase, Agalsidase-β (human α-galactosidase A), Botulinum toxin, Collagenase, Human DNAse-I, Hyaluronidase, Papain, L-Asparaginase, Uricase (Urate oxidase), glutamate carboxypeptidase (glucarpidase), α1 Protease inhibitor (α1 antitrypsin), Lactase, Pancreatic enzymes (lipase, amylase, protease), and Adenosine deaminase.

In another embodiment, the glycosylated target protein is secreted into the culture media, and wherein the glycosylated target protein is glycosylated. In certain embodiments, the glycosylated target protein is purified from the culture media. In another embodiment, the glycosylated target protein is purified from the culture media via affinity purification or ion exchange chromatography. In another embodiment, the glycosylated target protein contains an FC domain and is affinity purified from the culture media via protein-A. In another embodiment, the glycosylated target protein contains an affinity tag and is affinity purified.

In another embodiment, the population of glycosylated target protein is at least about 90%, 91%, 92%, 93%, 94%, 95%, 96%, 97%, 98%, 99%, or 100% homogeneous. In further embodiments, 90% to 100% of the N-glycosites on the target proteins that are occupied by glycosylation. In other embodiments, the target protein used in accordance with the methods and host cells described herein can be a full length protein, a truncation, a protein domain, a region, a motif or a peptide thereof.

In other embodiments, the target protein is an Fc-fusion protein.

In another embodiment, the target protein could be modified. In another embodiment, the target protein has been engineered to comprise a signal sequence from *Leishmania*. In other embodiments, the signal sequence is processed and removed from the target protein. In another embodiment, the target protein has been engineered to comprise one or more tag(s). In other embodiments, the tag is processed and removed from the target protein.

7.13 Compositions

7.13.1 Compositions Comprising Host Cells

In one aspect, provided herein are compositions comprising the host cells described herein (see Section 7.1). Such compositions can be used in methods for generating the glycosylated target proteins described herein, e.g., the compositions comprising host cells can be cultured under conditions suitable for the production of proteins. Subsequently, glycosylated target proteins can be isolated from said compositions comprising host cells using methods known in the art.

The compositions comprising the host cells provided herein can comprise additional components suitable for maintenance and survival of the host cells described herein, and can additionally comprise additional components required or beneficial to the production of proteins by the host cells, e.g., e.g., inducers for inducible promoters, such as arabinose, IPTG.

7.13.2 Compositions Comprising Glycosylated Target Proteins

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the N-linked glycosylation consensus sequences of the target proteins in the composition carry an oligosaccharide comprising the following structure:

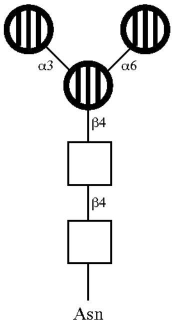

wherein the square represents an N-acetylglucosamine residue and the circle with vertical lines as fill pattern represents a mannose residue; and wherein the Asn is the Asn of the N-linked glycosylation consensus sequence in the target protein.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is G0-Gn glycan, characterized by either of the following structures:

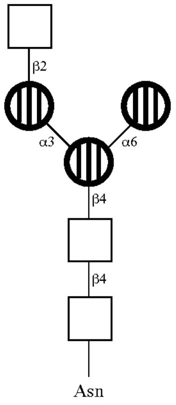

or

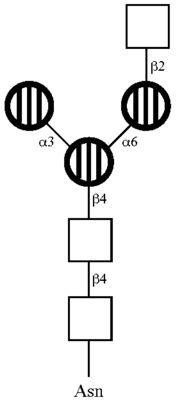

wherein the square represents an N-acetylglucosamine residue and the circle with vertical lines as fill pattern represents a mannose residue; and wherein the Asn is an Asn of an N-linked glycosylation consensus sequence in the target protein.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is G0 glycan, characterized by the following structure:

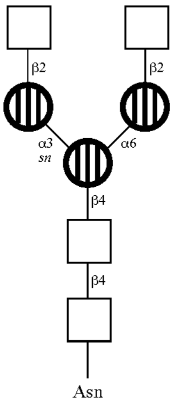

wherein the square represents an N-acetylglucosamine residue and the circle with vertical lines as fill pattern represents a mannose residue; and wherein the Asn is an Asn of an N-linked glycosylation consensus sequence in the target protein.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is G1-Gn glycan, characterized by either of the following structures:

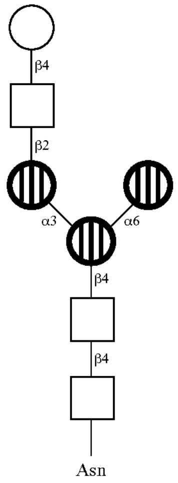

or

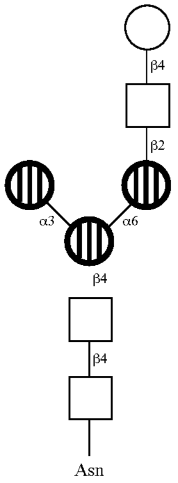

wherein the empty circle represents a galactose residue, the square represents an N-acetylglucosamine residue and the circle with vertical lines as fill pattern represents a mannose residue; and wherein the Asn is an Asn of an N-linked glycosylation consensus sequence in the target protein.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is G2 glycan, characterized by the following structure:

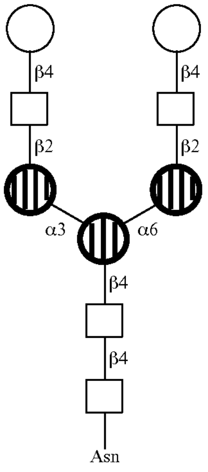

wherein the empty circle represents a galactose residue, the square represents an N-acetylglucosamine residue and the circle with vertical lines as fill pattern represents a mannose residue; and wherein the Asn is an Asn of an N-linked glycosylation consensus sequence in the target protein.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is G2 glycan, characterized by the following structure:

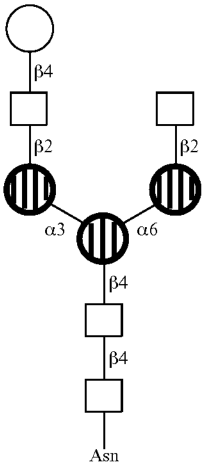

wherein the empty circle represents a galactose residue, the square represents an N-acetylglucosamine residue and the circle with vertical lines as fill pattern represents a mannose residue; and wherein the Asn is an Asn of an N-linked glycosylation consensus sequence in the target protein.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is G2 glycan, characterized by the following structure:

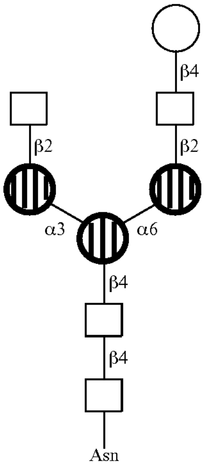

wherein the empty circle represents a galactose residue, the square represents an N-acetylglucosamine residue and the circle with vertical lines as fill pattern represents a mannose residue; and wherein the Asn is an Asn of an N-linked glycosylation consensus sequence in the target protein.

In another embodiment, the glycosylation on the target protein is further modified to optimize the pharmacokinetic properties of the target protein when introduced into a subject. In another embodiment, the glycosylation on the target protein is sialylated.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is characterized by the following structure:

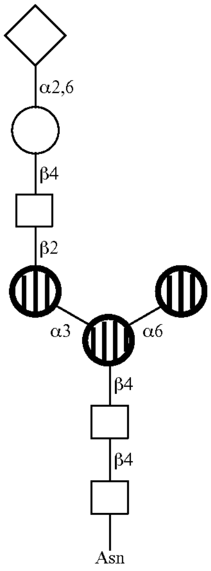

wherein the diamond represents a sialic acid residue, the empty circle represents a galactose residue, the square represents an N-acetylglucosamine residue and the circle with vertical lines as fill pattern represents a mannose residue; and wherein the Asn is an Asn of an N-linked glycosylation consensus sequence in the target protein.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is characterized by the following structure:

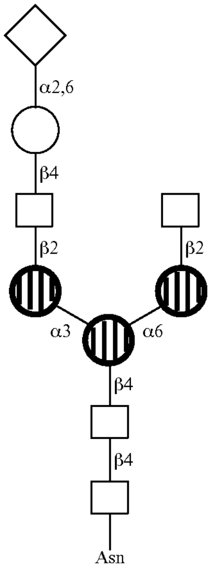

wherein the diamond represents a sialic acid residue, the empty circle represents a galactose residue, the square represents an N-acetylglucosamine residue and the circle with vertical lines as fill pattern represents a mannose residue; and wherein the Asn is an Asn of an N-linked glycosylation consensus sequence in the target protein.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is characterized by the following structure:

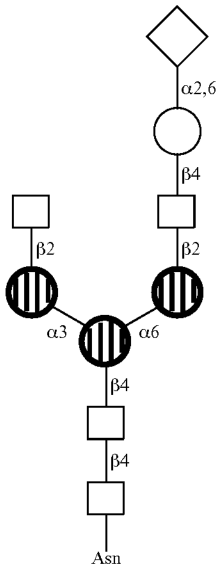

wherein the diamond represents a sialic acid residue, the empty circle represents a galactose residue, the square represents an N-acetylglucosamine residue and the circle with vertical lines as fill pattern represents a mannose residue; and wherein the Asn is an Asn of an N-linked glycosylation consensus sequence in the target protein.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is characterized by the following structure:

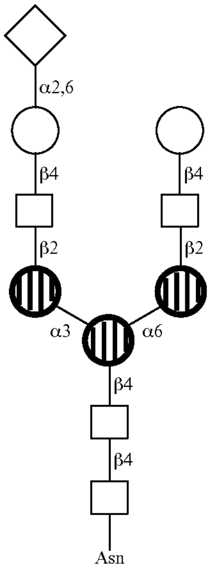

wherein the diamond represents a sialic acid residue, the empty circle represents a galactose residue, the square represents an N-acetylglucosamine residue and the circle with vertical lines as fill pattern represents a mannose residue; and wherein the Asn is an Asn of an N-linked glycosylation consensus sequence in the target protein.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is characterized by the following structure:

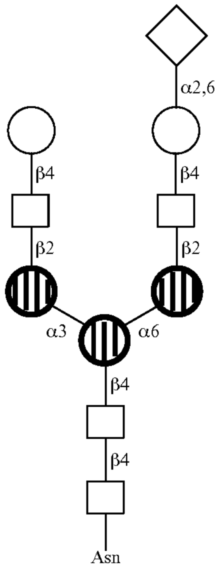

wherein the diamond represents a sialic acid residue, the empty circle represents a galactose residue, the square represents an N-acetylglucosamine residue and the circle with vertical lines as fill pattern represents a mannose residue; and wherein the Asn is an Asn of an N-linked glycosylation consensus sequence in the target protein.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is characterized by the following structure:

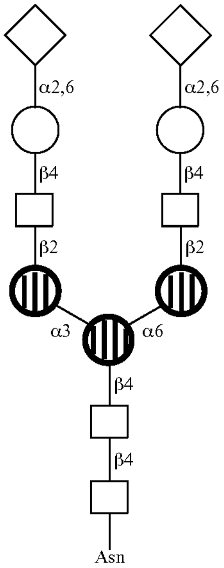

wherein the diamond represents a sialic acid residue, the empty circle represents a galactose residue, the square represents an N-acetylglucosamine residue and the circle with vertical lines as fill pattern represents a mannose residue; and wherein the Asn is an Asn of an N-linked glycosylation consensus sequence in the target protein.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is characterized by the following structure:

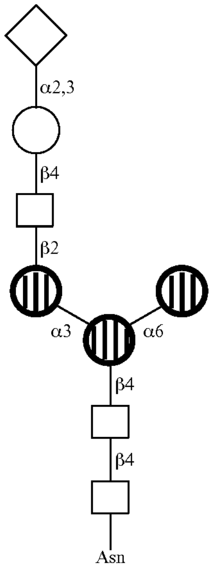

wherein the diamond represents a sialic acid residue, the empty circle represents a galactose residue, the square represents an N-acetylglucosamine residue and the circle with vertical lines as fill pattern represents a mannose residue; and wherein the Asn is an Asn of an N-linked glycosylation consensus sequence in the target protein.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is characterized by the following structure:

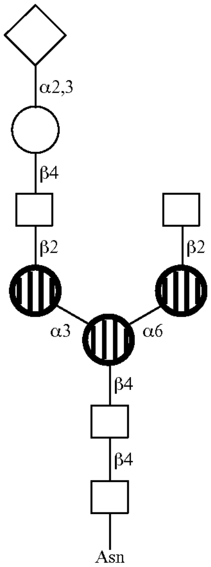

wherein the diamond represents a sialic acid residue, the empty circle represents a galactose residue, the square represents an N-acetylglucosamine residue and the circle with vertical lines as fill pattern represents a mannose residue; and wherein the Asn is an Asn of an N-linked glycosylation consensus sequence in the target protein.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is characterized by the following structure:

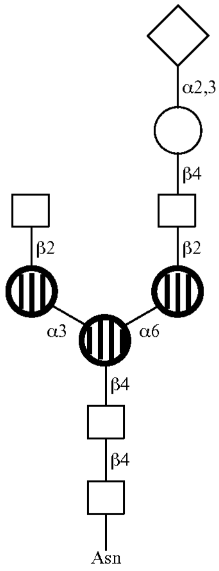

wherein the diamond represents a sialic acid residue, the empty circle represents a galactose residue, the square represents an N-acetylglucosamine residue and the circle with vertical lines as fill pattern represents a mannose residue; and wherein the Asn is an Asn of an N-linked glycosylation consensus sequence in the target protein.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is characterized by the following structure

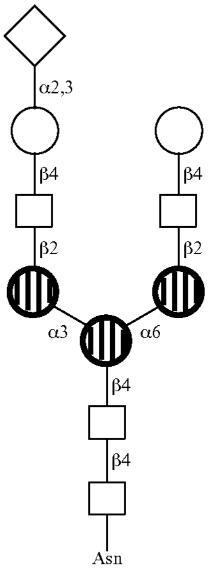

wherein the diamond represents a sialic acid residue, the empty circle represents a galactose residue, the square represents an N-acetylglucosamine residue and the circle with vertical lines as fill pattern represents a mannose residue; and wherein the Asn is an Asn of an N-linked glycosylation consensus sequence in the target protein.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is characterized by the following structure:

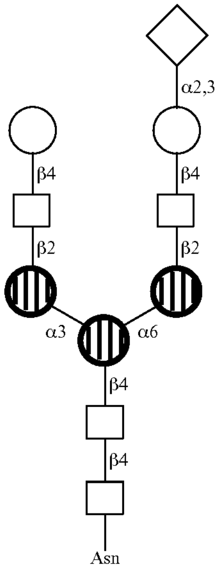

wherein the diamond represents a sialic acid residue, the empty circle represents a galactose residue, the square represents an N-acetylglucosamine residue and the circle with vertical lines as fill pattern represents a mannose residue; and wherein the Asn is an Asn of an N-linked glycosylation consensus sequence in the target protein.

In another embodiment, the composition of glycosylated target proteins have at least about 10 to 20%, 20% to 30%, 25% to 35%, 30% to 40%, 35% to 45%, 40% to 50%, 45% to 55%, 50% to 60%, 55% to 65%, 60% to 70%, 65% to 75%, 70% to 80%, 75% to 85%, 80% to 90%, 85% to 95%, or 90% to 100% of the glycosylation on the target protein is characterized by the following structure:

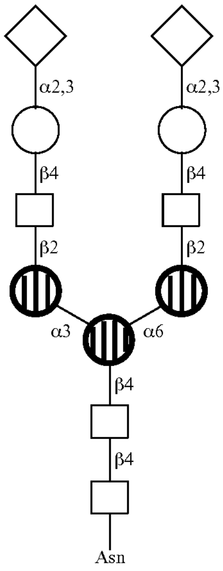

wherein the diamond represents a sialic acid residue, the empty circle represents a galactose residue, the square represents an N-acetylglucosamine residue and the circle with vertical lines as fill pattern represents a mannose residue; and wherein the Asn is an Asn of an N-linked glycosylation consensus sequence in the target protein.

In certain embodiments, in addition to comprising a glycosylated target protein described herein (see Section 7.12), the compositions (e.g., pharmaceutical compositions) described herein comprise a pharmaceutically acceptable carrier. As used herein, the term "pharmaceutically acceptable" means approved by a regulatory agency of the Federal or a state government or listed in the U.S. Pharmacopeia or other generally recognized pharmacopeiae for use in animals, and more particularly in humans. The term "carrier," as used herein in the context of a pharmaceutically acceptable carrier, refers to a diluent, adjuvant, excipient, or vehicle with which the pharmaceutical composition is administered. Saline solutions and aqueous dextrose and glycerol solutions can also be employed as liquid carriers, particularly for injectable solutions. Suitable excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. Examples of suitable pharmaceutical carriers are described in "Remington's Pharmaceutical Sciences" by E.W. Martin.

In certain embodiments, the compositions described herein are formulated to be suitable for the intended route of administration to a subject. For example, the compositions described herein may be formulated to be suitable for subcutaneous, parenteral, oral, intradermal, transdermal, colorectal, intraperitoneal, and rectal administration. In a specific embodiment, the pharmaceutical composition may be formulated for intravenous, oral, intraperitoneal, intranasal, intratracheal, subcutaneous, intramuscular, topical, intradermal, transdermal or pulmonary administration.

In certain embodiments, the compositions described herein additionally comprise one or more buffers, e.g., phosphate buffer and sucrose phosphate glutamate buffer. In other embodiments, the compositions described herein do not comprise buffers.

In certain embodiments, the compositions described herein additionally comprise one or more salts, e.g., sodium chloride, calcium chloride, sodium phosphate, monosodium glutamate, and aluminum salts (e.g., aluminum hydroxide, aluminum phosphate, alum (potassium aluminum sulfate), or a mixture of such aluminum salts). In other embodiments, the compositions described herein do not comprise salts.

The compositions described herein can be included in a kit, container, pack, or dispenser together with instructions for administration.

The compositions described herein can be stored before use, e.g., the compositions can be stored frozen (e.g., at about −20° C. or at about −70° C.); stored in refrigerated conditions (e.g., at about 4° C.); or stored at room temperature.

7.14 Prophylactic and Therapeutic Use

In one aspect, provided herein are methods of preventing or treating a disease or disorder in a subject comprising administering to the subject a glycosylated target protein described herein or a composition thereof. Further provided herein are methods of preventing a disease or disorder in a subject comprising administering to the subject a glycosylated target protein described herein or a composition thereof.

8. EXAMPLES

8.1 Example 1 Bioinformatic Assessment of Glycosylation Pathways

First, *Leishmania tarentolae* was found to be substantially different in the early conserved N-glycan biosynthesis steps by comparative genome analyses, even to the taxonomically close *Leishmania major*, as described in Table 1, Table 2, Table 3, Table 4, Table 5, Table 6 and Table 7. Missing alg genes indicate a strongly reduced N-glycan precursor and also a reduced precursor trimming (FIG. 3 and FIG. 4) (Varki, 2009). Although ALG3 is present, a comparison to human ALG3 reveals a potential missense mutation at the conserved residue 127 to Glutamine, which corresponds to a loss-of-function mutation (R171Q) in human ALG3 (Sun et al. 2005).

TABLE 1

| Precursor Biosynthesis | | | | | |
|---|---|---|---|---|---|
| | | *L. tarentolae* | Previous naming scheme (Raymond et al. 2012) | Interpretation | *L. major* |
| ALG1 | Mannosyl-transferase | LTAR_180015100.1 | LtaP18.0910 | Present | LmjF.18.0900 |
| ALG2 | Mannosyl-transferase | LTAR_340026600.1 | LtaP34.2270 | Present | LmjF.34.2420 |
| ALG3 | Alpha-1,3 mannosyl-transferase | LTAR_360026500.1 | LtaP36.2050 | Present, but possible loss-of-function due to point mutation | LmjF.36.2040 |
| ALG5 | UDP-glucose:dolichyl-phosphate glucosyl-transferase | | | Assumed as absent (homology to DPM1) | |
| ALG6 | Alpha-1,3 glucosyl-transferase | None | | Absent | none |

TABLE 1-continued

| Precursor Biosynthesis | | | | | |
|---|---|---|---|---|---|
| | | *L. tarentolae* | Previous naming scheme (Raymond et al. 2012) | Interpretation | *L. major* |
| ALG7 | UDP-N-acetyl-glucosamine-1-P transferase | LTAR_360057600.1 | LtaP36.4320 | Present | LmjF.36.4180 |
| ALG8 | Glucosyl transferase | None | | Absent | none |
| ALG9 | Mannosyl-transferase | None | | Absent | LmjF.12.0160 |
| DIE2 = ALG10 | Alpha-1,2 glucosyl-transferase | None | | Absent | none |
| ALG11 | Alpha-1,2-mannosyl-transferase | LTAR_340026600.1 | LtaP34.2270 | Assumed as absent (homology to ALG2) | LmjF.35.5250 |
| ALG12 | Alpha-1,6-mannosyl-transferase | None | | Absent | none |
| ALG13 | Component of UDP-GlcNAc transferase | LTAR_300010400.1 | LtaP30.0600 | ALG13/14 bifunctional as yeast | LmjF.30.0530 |
| ALG14 | Component of UDP-GlcNAc transferase | LTAR_300010400.1 | LtaP30.0600 | ALG13/14 bifunctional as yeast | LmjF.30.0530 |
| SEC59 | Dolichol kinase | LTAR_350033100.1 | LtaP35.2950 | Present | LmjF.35.2930 |
| DPM1 | Dol-P-Man synthase | LTAR_360007100.1 | LtaP36.0200 | Present | LmjF.36.0220 |
| RFT1 | Translocator of Man5GlcNac 2-PP-Dol | LTAR_280030200.1 | LtaP28.2480 | Present | LmjF.28.2410 |
| PMM2 | Phospho-mannomutase | LTAR_360025600.1 | LtaP36.1960 | Present | LmjF.36.1960 |
| MPI | Mannose-6-phosphate isomerase | LTAR_320021400.1 | LtaP32.1690 | Present | LmjF.32.1580 |

TABLE 2

| Trimming | | | | | |
|---|---|---|---|---|---|
| | | *L. tarentolae* | Previous naming scheme (Raymond et al. 2012) | Interpretation | *L. major* |
| GCS1 | Mannosyl-oligosaccharide glucosidase | LTAR_280028000.1 | LtaP28.2280 | Present | LmjF.28.2200 |
| GANAB | Neutral alpha-glucosidase | LTAR_180005800.1 | LtaP18.0090 | Present | LmjF.18.0090 |
| MNS1 | Mannosyl-oligosaccharide 1,2-alpha-mannosidase | None | | Absent | none |
| MAN1 | Mannosyl-oligosaccharide 1,2-alpha-mannosidase | LTAR_090021500.1 | LtaP09.1430 | Presumably present (has alpha-mannosidase domain, but not reciprocal best hit) | LmjF.09.1400 |
| MAN2 | Alpha-mannosidase 2 | None | | Absent | none |
| EBM | Mannosyl-glycoprotein endo-beta-mannosidase | None | | Absent | None |

TABLE 2-continued

| Trimming | | | | |
|---|---|---|---|---|
| | *L. tarentolae* | Previous naming scheme (Raymond et al. 2012) | Interpretation | *L. major* |
| Endo-alpha-mannosidase | None | | Absent (based on Glycosyl hydrolase family 99) | None |

TABLE 3

| N-glycan elongation | | | | | |
|---|---|---|---|---|---|
| | | *L. tarentolae* | Previous naming scheme (Raymond et al. 2012) | Interpretation | *L. major* |
| MGAT1 | Alpha-1,3-mannosyl-glycoprotein 2-beta-N-acetyl-glucosaminyl-transferase | None | | Absent | None |
| MGAT2 | Alpha-1,6-mannosyl-glycoprotein 2-beta-N-acetyl-glucosaminyl-transferase | None | | Absent | None |
| FUT8 | Alpha-(1,6)-fucosyl-transferase | None | | Absent | None |
| FUT13 | Alpha-(1,4)-fucosyl-transferase | LTAR_020007600.1 | LtaP02.0260 | Also homology to FUT11 | LmjF.02.0330 |
| B4GALT1-3 | Beta-1,4-galactosyl-transferase | None | | Absent | None |
| SIAT1-2 | Beta-galactoside alpha-2,6-sialyltransferase | None | | Absent | None |
| XYLT | Beta-(1,2)-xylosyl-transferase | None | | Absent | None |
| TbGnTI | UDP-GlcNAc:α-3-D-mannoside β-1-2-GlcNAc transferase I | | | Close homology of N-Glycan- and LPG-GlcNAc-transferases; function cannot be differentiated in silico. | |
| TbGnTII | UDP-GlcNAc:α-1-6-D-mannoside-β-1-2-N-acetyl-glucosaminyl-transferase II | | | | |
| TbGT8 | bifunctional GPI + N-linked GlcNAc-transferase | | | | |
| TbGT3 | GPI anchor side chain modifier (beta 1-3 galactosyl-transferase) | | | | |

TABLE 4

| Oligosaccharyltransferase (OST) | | | | | |
|---|---|---|---|---|---|
| | | *L. tarentolae* | Previous naming scheme (Raymond et al. 2012) | Interpretation | *L. major* |
| STT3 | Dolichyl-diphospho-oligosaccharide--protein glycosyl-transferase subunit STT3 | LTAR_350014800.1<br>LTAR_350014900.1<br>LTAR_350015000.1 | LtaP35.1240 (not fully resolved in published genome) | Homolog present | LmjF.35.1160<br>LmjF.35.1150<br>LmjF.35.1140<br>LmjF.35.1130 |
| OST1 | Dolichyl-diphospho-oligosaccharide--protein glycosyl-transferase subunit 1 | None | | Absent | None |
| OST2 | Dolichyl-diphospho-oligosaccharide--protein glycosyl-transferase subunit 2 | None | | Absent | None |
| OST3 | Dolichyl-diphospho-oligosaccharide--protein glycosyl-transferase subunit 3 | None | | Absent | None |
| OST4 | Dolichyl-diphospho-oligosaccharide--protein glycosyl-transferase subunit 4 | None | | Absent | None |
| OST5 | Dolichyl-diphospho-oligosaccharide--protein glycosyl-transferase subunit 5 | None | | Absent | None |
| OST6 | Dolichyl-diphospho-oligosaccharide--protein glycosyl-transferase subunit 6 | None | | Absent | None |
| WBP1 | Dolichyl-diphospho-oligosaccharide--protein glycosyl-transferase subunit WBP1 | None | | Absent | None |
| SWP1 | Dolichyl-diphospho-oligosaccharide--protein glycosyl-transferase subunit SWP1 | None | | Absent | None |

TABLE 5

| Precursor biosynthesis (Neu5Ac) | | | | | |
|---|---|---|---|---|---|
| | | *L. tarentolae* | Previous naming scheme (Raymond et al. 2012) | Interpretation | *L. major* |
| GNE | Bifunctional UDP-N-acetyl-glucosamine 2-epimerase/N-acetyl-mannosamine kinase | None | | Absent | None |
| NANS | Sialic acid synthase | None | | Absent | None |
| NANP | N-acylneur-aminate-9-phosphatase | None | | Absent | None |
| CMAS | N-acylneur-aminate cytidylyltrans-ferase | None | | Absent | None |
| CST | CMP-sialic acid transporter | LTAR_180008900.1<br>LTAR_240008400.1 | LtaP18.0420<br>LtaP24.0350 | Supposed to be the UDP-Gal or UDP-GlcNAc transporter | LmjF.18.0400<br>LmjF.24.0360 |

TABLE 6

| Nucleotide activated sugar synthesis and transport | | | | | |
|---|---|---|---|---|---|
| | | *L. tarentolae* | Previous naming scheme (Raymond et al. 2012) | Interpretation | *L. major* |
| UGP | UDP-glucose pyro-phosphorylase | LTAR_180015800.1 | LtaP18.0980 | Present | LmjF.18.0990 |
| USP | UDP-sugar pyro-phosphorylase, | LTAR_170022300.1 | LtaP17.1310 | Present | LmjF.17.1160 |
| GalE | UDP-galactose 4-epimerase | LTAR_330034700.1 | LtaP33.2520 | Present | LmjF.33.2300 |
| TbNST1/ LPG5B | UDP-Gal, UDP-GlcNAc importer | LTAR_180008900.1 | LtaP18.0420 | Present | LmjF.18.0400 |
| TbNST2/ LPG5A | UDP-Gal, UDP-GlcNAc importer | LTAR_240008400.1 | LtaP24.0350 | Present | LmjF.24.0360 |
| TbNST3/ LPG2 | GDP-Man, UDP-GlcNAc importer | LTAR_340034000.1 | LtaP34.3030 | Present | LmjF.34.3120 |
| TbNST4 | UDP-GlcNAc, UDP-GalNAc, GDP-Man importer | LTAR_300033500.1 | LtaP30.2670 | Present | LmjF.30.2680 |
| HUT1L | UDP-Glc importer | LTAR_220014900.1 | LtaP22.0970 | Present | LmjF.22.1010 |

TABLE 7

| Lipophosphoglycan modifying enzymes | | | | | |
|---|---|---|---|---|---|
| | | *L. tarentolae* | Previous naming scheme (Raymond et al. 2012) | Interpretation | *L. major* |
| LPG1 | Galacto-furanosyl glycosyl-transferase | LTAR_250005000.1 | LtaP25.0010 | Present | LmjF.25.0010 |
| LPG2 | GDP-fucose importer | LTAR_340034000.1 | LtaP34.3030 | Present | LmjF.34.3120 |
| LPG3 | Lipophospho-glycan biosynthetic protein | LTAR_290012500.1 | LtaP29.0800 | Present | LmjF.29.0760 |

Following the surprisingly unique biosynthesis pathway as outlined in FIG. 3B, the reduced trimming and endoplasmic reticulum (ER) quality control (Table 1, Table 2 and Table 8) suggest beneficial properties for glycoengineering modifications in terms of high site occupancy while retaining a proper folding process. FIG. 5 describes in more detail the present chaperone pathways for correct glycoprotein folding with the absence of lectin mediated (Calnexin and calreticulin) pathways that usually cycle improperly trimmed N-glycan precursor back or unfolded proteins to the ERAD pathway for proteasome degradation (Moremen et al., 2012), also outlined in Table 8. Importantly, the OST complex is only composed of SttO that transfers the precursor N-glycan, to the protein acceptor consensus asparagine (Table 4). In case of *L. tarentolae* a reduced precursor differing significantly to any other described eukaryotic organism is transferred by Stt3, implying that there are no or no strict site preferences as in other eukaryotic organisms containing OST complexes.

TABLE 8

| ER Quality control | | | | | |
|---|---|---|---|---|---|
| | | *L. tarentolae* | Previous naming scheme (Raymond et al. 2012) | Interpretation | *L. major* |
| CNE1 | Calnexin | None | | Absent in L. tar | Absent |
| | Calreticulin | LTAR_310032700.1 | Not resolved in published genome | Non-functional; pseudogene | LmjF.31.2600 |
| UGGT | UDP-glucose:glyco-protein glucosyl-transferase 1 | None | | Absent in L. tar | LmjF.29.2110 |
| ERGIC1 | Endoplasmic reticulum-Golgi intermediate compartment protein 1 | LTAR_320045300.1<br>LTAR_110005100.1 | LtaP32.4080 | Present | LmjF.32.3910 |
| EDEM1,3 | ER degradation-enhancing alpha-mannosidase-like protein | None | | Absent | None |
| YOS9 | ER quality-control lectin | None | | Absent | None |
| ERp57 | Disulfide isomerase | LTAR_360087300.1 | LtaP36.7210 | Present | LmjF.36.6940 |
| BiP | 78 kDa glucose-regulated protein | LTAR_280017500.1<br>LTAR_280017600.1<br>LTAR_280017700.1<br>LTAR_280017800.1<br>LTAR_280017900.1 | LtaP28.1270 (not fully resolved in published genome) | Present | LmjF.28.1200 |
| VCP | Transitional endoplasmic reticulum ATPase | LTAR_360019200.1 | LtaP36.1350 | Present (more homologs found) | LmjF.36.1370 |
| PNG1 | Peptide-N(4)-(N-acetyl-beta-glucosaminyl) | None | | Absent | None |

TABLE 8-continued

| ER Quality control | | | | | |
|---|---|---|---|---|---|
| | | *L. tarentolae* | Previous naming scheme (Raymond et al. 2012) | Interpretation | *L. major* |
| SEL1L | asparagine amidase Scaffold protein for the major ERAD component, the HRD1 complex | LTAR_070011100.1 | Not resolved in published genome | Present | LmjF.07.0590 |

As an generally accepted view, FIGS. 6 and 7 show the schematic representation of the N-glycan processing steps that take place in the endoplasmic reticulum and the Golgi apparatus of eukaryotic cells, Fig. adapted from (Kellokumpu et al. 2016). In *L. tarentolae*, the truncated, reduced precursor is transferred to the protein and it is missing any further N-glycan elongation in the Golgi along its traffic along the secretory pathway. This has been concluded by the absence of GlcNAc transferases GnT-I and GnT-II, Gal transferases and Sialyltransferases (FIG. 6, Table 6). Additionally the comparative data showed the absence of steps of sialic acid biosynthesis (Table 5). Golgi resident GlcNAc glycosyltransferases from closely related *Trypanosoma brucei* TbGnTI (Damerow et al. 2014) and TbGnTII (Damerow et al. 2016) could not unambiguously identified in *L. tarentolae*. TbGnTI and TbGnTII, epitope tagged at the C-terminus were shown to be Golgi localized by immune fluorescence (Damerow et al. 2014; Damerow et al. 2016).

As the nucleotide activated sugar donors are required for the enzymatic reaction catalyzed by the glycosyltransferases and need to be available inside the lumen of the Golgi compartment, the presence of transmembrane localized transporters were identified by a bioinformatic approach. Presence of homologues to UDP-glucose pyrophosphorylase, UDP-sugar pyrophosphorylase, UDP-galactose 4-epimerase and UDP-Gal/UDP-GlcNAc importers, GDP-Man/UDP-GlcNAc importer, UDP-GlcNAc/UDP-GalNAc, GDP-Man importer and UDP-Glc importer (Roper and Ferguson 2003; Roper et al. 2002; Urbaniak et al. 2006; Capul et al. 2007) was identified (Table 6). UDP-GlcNAc transporters (*T. cruzi* TcNST1, and *T. brucei* TbNST1 to 4, *L. major*) are present in *L. tarentolae*, UDP-Gal transporter (*T. brucei* TbNST 1 and 2, *L. major*) are present in *L. tarentolae*. These results indicate that both, UDP-GlcNAc and UDP-Gal can be transported to the Golgi lumen. Therefore, LTAR_180008900.1, LTAR_240008400.1, LTAR_340034000.1 and LTAR_300033500.1 (previous naming scheme: LtaP18.0420, LtaP24.0350, LtaP34.3030 and LtaP30.2670) suggest the availability of GDP-Gal and UDP-GlcNAc inside the Golgi lumen.

8.2 Example 2 Approach for Glycoengineering Fully Function-Customized N-Glycan Variants FIGS. 7 and 8 capture the glycoengineering design for generating homogeneous and function-customized N-glycan elongation in *L. tarentolae* for a) desired downstream effects of Fc and Fc receptor interactions and b) for half-life increase (Pharmacokinetics, PK, increase) and c) anti-inflammatory properties (like immune-tolerizing benefits of 2,6 linked Neu5Ac in order to avoid generation of ADA in potentially immunogenic protein therapeutics. FIG. 8 describes the proposed for *L. tarentolae* N-glycan biosynthesis, showing the main and novel differences leading to beneficial properties for glycoengineering. The present invention relates to eukaryotic host cells, which have been modified to produce function-customized and homogeneous N-glycans on proteins by the heterologous expression of a set of glycosyltransferases, including N-acetylglucosamine transferases, galactosyltransferase, and sialyltransferases.

8.3 Example 3 Experimental Evidence for a Reduced and 100% Homogeneous N-Glycan in Kinetoplastid *Leishmania tarentolae*

After selecting the *L. tarentolae* Kinetoplastida organism based on expected beneficial properties, three wild type (wt) strains (St10569, St10616, St 1262) were analyzed for their native N-glycans. First, cell pellets were denatured and subjected to either PNGaseA or PNGaseF mediated N-glycan release. The released N-glycans were a) permethylated or b) labeled with Waters GlycoWorks™ RapiFluor-MS™ N-Glycan for the fast enzymatic release and rapid labeling of N-glycans.

By fluorescent labeling using RapiFluor™ and UPLC separation, we have only observed one single N-glycan form corresponding to $(Man)_3(GlcNAc)_2$ with calculated m/z=1222.7166; $[M+Na]^+$ 1244.6985; $[M+K]^+$ 1260.6724. For the N-glycans only one homogeneous N-glycans was identified, the so called paucimannose or Man3 glycan, in all of the three isolated *L. tarentolae* cells FIG. 9.

We have also applied permethylation to elucidate the N-glycan profiles of two different wt samples (St10569, St10616) of *Leishmania tarentolae*. Independent of the approach (deglycosylation of tryptic peptides obtained from delipidated cell pellets or direct deglycosylation of intact proteins after delipidation of the cell pellets) the presence of one N-glycan structure was confirmed in both strains. This N-glycan corresponding to the basic $(Man)_3(GlcNAc)_2$ core is obtained independently of the N-glycosidase used for deglycosylation. Mock controls indicated the presence of cell wall contaminating glycans, presumably from lipophosphoglycans, shown by polyhexose signatures. Although a contamination with poly-hexoses was observed in MALDI spectra of the extracts, we did not discover any ions potentially corresponding to more complex N-glycans. Notably, the supposed bi-antennary fucosylated glycan $(Gal)_2(GlcNAc)_2(Fuc)_1+(Man)_3(GlcNAc)_2$ (G2F) (Breitling et al. 2002) with α1,6- or α1,3 linked fucose (theoretical permethylated mass $[M+Na]^+$ of 2244.1) was not discovered.

Spectra did not contain any traces of ions with this m/z value. It is also worth mentioning that no possible intermediates between the core structure and other complex fucosylated, N-acetyl glucosaminylated or galactosylated structures were observed. No precursors of the N-glycosylation pathway in the Golgi have been identified either (e.g. $Man_5GlcNAc_2$). This point is really unusual if the biosynthesis of N-glycans in *Leishmania tarentolae* is comparable to other organisms. Spectra, obtained after deglycosylation with PNGase F or PNGase A, were identical. There is in consequence no indication that N-glycan profiles of *Leishmania tarentolae* cell pellets contain N-glycans with α1,3-linked core fucose that would not be released by PNGase F (data not shown).

To further determine how the N-glycan of *L. tarentolae* differs from N-glycans of other Kinetoplastidae, *Crithidia fasciculata, Phytomonas davidi* Lafont and *Chrithidia deanei* (*Angomonas*) were further investigated by genomic analysis and by N-glycan profiling. Compared to *L. tarentolae, C. fasciculata* additionally contains the mannosyltransferases ALG3, ALG9 and ALG11 that explain the experimentally verified synthesis of a high mannose glycan (Man5GlcNAc2 to Man11GlcNAc2) (FIG. 45). Furthermore, *C. fasciculata* possesses calreticulin, a quality-control chaperone that is missing in *L. tarentolae*. No genomic information was available for *P. davidi* Lafont. N-glycan profiling by PNGaseF and PNGaseA and subsequent permethylation and MALDI-TOF revealed a high mannose type glycan (Man9GlcNAc2) harboring one or two additional pentoses. The bioinformatics comparison of the glycosylation pathways of *C. deanei* and *L. tarentolae* revealed no differences besides the absence of MAN1 in *C. deanei*. However, N-glycan profiling showed that the core N-glycan (Man3GlcNAc2) is additionally decorated by 2 hexoses and 2 deoxyhexoses (FIG. 45).

Taken together, only one homogeneous N-glycan basic, a $(Man)_3(GlcNAc)_2$, was identified in 3 *L. tarentolae* wt strains by different experimental methods. This homogeneous N-glycosylation with $(Man)_3(GlcNAc)_2$, which is also called Man3, or paucimannose, has never been observed in any other eukaryotic organism and represents a novel feature for using this organism as expression host for therapeutic proteins aiming for homogeneous N-glycosylation and glycoengineering humanized N-glycans with retaining high site occupancy.

8.4 Example 4 Identification of Heterologous Glycosyltransferases that Elongate the Native Paucimannose N-Glycan In Vitro For achieving a humanized extended biantennary N-glycan, the suitable Gnts were recombinantly expressed in *L. tarentolae* and affinity enriched from *L. tarentolae* crude lysates, membrane solubilized fraction, and media supernatants. The semi-purified enzymes were tested in vitro for their proper activity with co-factors and the relevant activated nucleotide sugar donors. Substrates were either "free" N-glycans, 2-Aminobenzamide (2AB) labeled N-glycans or crude lysates from wt cells containing only paucimannose (Man3).

The invention covers the expression of different and suitable glycosyltransferase candidates (Table 9) that were analyzed on their effect in in vitro assays that showed that all tested heterologous Gnt candidates from insect or mammalian origin expressed and purified from *L. tarentolae* cells could perform their activity on free oligosaccharide substrate or 2AB labeled substrate in presence of co-factors and their activated sugar donors (FIGS. 10-14).

TABLE 9

GnT candidates

| Name | | Other names | accession number | species |
|---|---|---|---|---|
| MGAT1 | N-acetylglucosaminyl-transferase 1 | hMGAT1 | P26572 | *Homo sapiens* |
| | | SfGnT-I | AEX00082 | *Spodoptera frugiperda* |
| | | TbGnT-I | XP_844156 | *Trypanosoma brucei* |
| | | PtMGAT1 | XP_001155433.2 | *Pan troglodytes* |
| | | MaMGAT1 | NP_001244759. | *Macaca mulatta* |
| | | MuMGAT1 | NP_001103620.1 | *Mus musculus* |
| | | RnMGAT1 | NP_110488.1 | *Rattus norvegicus* |
| | | DrMGAT1a | NP_956970.1 | *Danio rerio A* |
| | | DmMGAT1 | NP_525117.2 | *Drosophila melanogaster* |
| | | AgMGAT1 | XP_315359.3 | *Anopheles gambiae* |
| | | Ce14MGAT1 | NP_497719.1 | *Caenorhabditis elegans* gly-14 |
| | | Ce13MGAT1 | NP_509566.1 | *Caenorhabditis elegans* gly-13 |
| | | AtMGAT1 | NP_195537.2 | *Arabidopsis thaliana* |
| | | OsJMGAT1 | XP_015624616.1 | *Oryza sativa Japonica* |
| | | XtMGAT1 | NP_001011350.1 | *Xenopus tropicalis* |
| | | ClMGAT1 | XP_855658.1 | *Canis lupus* |
| | | BtMGAT1 | NP_001015653.1 | *Bos taurus* |
| | | DrMGAT1b | NP_001073440.1 | *Danio rerio* B |

TABLE 9-continued

| GnT candidates | | | | |
|---|---|---|---|---|
| Name | | Other names | accession number | species |
| | | GjMGAT1 | XP_015280466.1 | *Gekko japonicus* |
| MGAT2 | N-acetylglucosaminyl-transferase 2 | rMGAT2 | NP_446056 | *Rattus norvegicus* |
| | | SfGnT-II | AEX00083 | *Spodoptera frugiperda* |
| | | hMGAT2 | Q10469.1 | *Homo sapiens* |
| | | TbGnT-II | XP_845654 | *Trypanosoma brucei* |
| B4GALT1 | Beta-1,4-galactosyl-transferase 1 | B4GALT1 | NP_001488.2 | *Homo sapiens* |
| ST6GAL1 | Beta-galactoside alpha-2,6-sialyltransferase 1 | hST6GAL1 | P15907.1 | *Homo sapiens* |
| | Beta-galactoside alpha-2,6-sialyltransferase 1 | mST6GAL1 | Q64685.2 | *Mus musculus* |
| | Beta-galactoside alpha-2,6-sialyltransferase 1 | rST6GAL1 | P13721.1 | *Rattus norvegicus* |
| ST3GAL3 | Beta-galactoside alpha-2,3-sialyltransferase 3 | mST3GAL3 | P97325.2 | *Mus musculus* |
| ST3GAL4 | Beta-galactoside alpha-2,3-sialyltransferase 4 | hST3GAL4 | Q11206.1 | *Homo sapiens* |
| CstI | alpha-2,3-sialyltransferase | | AAF13495.1 | *Campylobacter jejuni* |
| CstII | bifunctional sialyltransferase | | PDB: 2DRJ_A | *Campylobacter jejuni* |
| PmST1 | alpha-2,3/2,6-sialyltransferase/sialidase | | AAY89061.1 | *Pasteurella multocida* |
| PdST6 | alpha-2,6-sialyltransferase | | BAA25316.1 | *Photobacterium damselae* |
| PdST6_b | hypothetical alpha-2,6-sialyltransferase | | WP_005298232.1 | *Photobacterium damselae* |
| PlST6_a | alpha 2,6-sialyltransferase | | BAF91416.1 | *Photobacterium leiognathi* JT-SHIZ-145 |
| PlST6_b | alpha 2,6-sialyltransferase | | BAI49484.1 | *Photobacterium leiognathi* JT-SHIZ-119 |
| PspST6 | beta-galactoside alpha-2,6-sialyltransferase | | BAF92026.1 | *Photobacterium* sp. JT-ISH-224 |

The GnT-I ("TbGnT-I") from the taxonomically closest related organism, *Trypanosoma brucei*, did not show any activity on wt lysate containing native paucimannose as substrate (FIG. 10). However minor activity (peak overlap) on free paucimannose (Man3) as substrate was observed. The TbGnT-II did not show any activity on the Man3 substrates, which could also indicate a prerequisite of the GntI preceding activity. Insect cell derived SfGnT-I activity was confirmed when semi-purified by Streptavidin elution or solubilized fraction was used in the in vitro assay on free paucimannose, with a distinctive peak appearing co-migrating with the NGA2-N standard. Controls contained either HA- or Strep-elution of a wt lysate but did not show any modifications on the substrates used.

hMGAT1 was purified from lysate+/−TritonX (TrX) and hMGAT1 HA-elution fraction from cell pellets showed ~100% elongation of 2AB-Man5 (FIG. 11A) and ~100% 2AB-Man3 (FIG. 11B) substrates. MGAT-I elution fraction from HA-enrichment of supernatant (SN) had only a minimal activity on 2AB-Man5 or 2AB-Man3. The lysate from wt as negative control did not affect the 2AB-Man5 retention time or modify the standard.

rMGAT2 when HA enriched from supernatant or from membrane fractions ("pellet") efficiently converted NGA2-N standard to the G0 (NGA2) form (FIG. 12A). As expected, rMGAT-2 is not able to elongate 2AB-Man3a to NGA2-N in vitro (FIG. 12B). MGAT2 requires preceding GnT-I activity. NGA2-N standard is composed of both forms, GlcNAc on the $\alpha$1,3- and on $\alpha$1,6-linked Man branch with about 50% each, according to manufacturer. Peak of NGA2-N and NGA2 is 50/50, subsequently the in vitro conversion of $\alpha$1,6 is 100% by rMGAT2.

SfGnT-II localized intracellularly and was detected in cell lysates+/−1% (v/v) TritonX showing membrane association, however non-exclusively (FIG. 13). SfGnT-II had low presence in SN unlike the other investigated Gnt candidate SfGnT-I. In vitro activity assay using HA-fractions was not conclusive due to the background noise. SfGnT-II in lysate showed conversion of NGA2-N to some rather low extent, possibly due to the low amount present in crude lysate (FIG. 13B). In vitro activity samples with SfGnT-II HA-elutions of either SN or lysate (+TrX) showed strong background fluorescence on pure 2AB-standards used as substrate (not shown). SfGnT-II also requires preceding GnT-I activity (FIG. 13A) and does not act on Man5 (FIG. 13C)

Substrate NGA2-N (green, 76.8 m) was used to assess in vitro hB4GALT-I activity (FIG. 14A). Streptavidin purified hB4GALT-I converted NGA2-N (green) to hypothetically equal proportions of $\alpha$1-3 and $\alpha$1-6 G1-Gn (a) and G1-Gn (b) (FIG. 14B); the conversion was not at 100%, since a weak (blue) peak is detected at 76.8 m. However, at least >90% conversion is expected. "Twin peaks" of B4GALT-I samples show identical pattern as the "twin" peaks from G1 standard (red), however, with shorter retention time due to the 1×GlcNAc less in the structure. FIG. 14C shows the expected function of B4GALT1 on G0 substrate in vivo leading to G2 glycoforms.

8.5 Example 5 Identification of Heterologous Glycosyltransferases that Elongate the Native Paucimannose N-Glycan on Native Proteins In Vivo Next, the recombinant host cells expressing glycosyltransferases were collected and treated to release their N-glycans with PNGaseF. Released glycans were permethylated or 2AB labeled and the activity on native glycoprotein acceptors was analyzed. Cells expressing GnT-I (SfGnT-I, St11707) converted the paucimannose to 34% NGA2-N (G0-Gn) in vivo. As samples are from crude cell extracts, also endoplasmic reticulum (ER) localized glycoproteins are included, meaning that these proteins do not transit through the Golgi for obtaining a GlcNAc elongation. Cells expressing only GnT-II candidate (not shown) were not able to extend the paucimannose as expected, due to the requirement of the preceding activity of GnT-I, a finding that was corroborated by the in vitro analyses. When co-expressing recombinantly a GnT-I along with a GnT-II enzyme (SfGnT-I and SfGnT-II, St12320) the elongation of paucimannose with 2 GlcNAc to the G0 forms was confirmed (FIGS. 15 and 16).

Analyzed by permethylation and MALDI TOF, cell pellet sample St10569 P16_378 wild type contained only one N-glycan structure $(Man)_3(GlcNAc)_2$ (m/z 1171.6). Expression of Gnt-I in sample St11707 P16_378 from *Leishmania tarentolae* St11707 genotype ssu::SfGnT-I led to the presence of both $(Man)_3(GlcNAc)_2$ (m/z 1171.6) and $(GlcNAc)_1(Man)_3(GlcNAc)_2$ (m/z 1416.7) with relative intensities of respectively 66 and 34%. Co-expression of both GnT1 and GnT2 in St12320 P16_378 from *Leishmania tarentolae* St12320 genotype ssu::SfGnT-I;ssu::SfGnT-II (polyclonal) led to the presence of three distinct N-glycan structures, $(Man)_3(GlcNAc)_2$ (m/z 1171.6), $(GlcNAc)_1(Man)_3(GlcNAc)_2$ (m/z 1416.7) and $(GlcNAc)_2(Man)_3(GlcNAc)_2$ (m/z 1661.8) at respectively 48, 15 and 37% (FIG. 15).

Furthermore ions corresponding to N-glycan structures were fragmented by MALDI-TOF/TOF MS. Fragment ions present in the spectrum of m/z 1171.6 confirm the N-glycan structure (Man)3(GlcNAc)2. Fragment ions present in the spectrum of m/z 1416.7 confirm the N-glycan structure (GlcNAc)1(Man)3(GlcNAc)2. GnT-I catalyzes the transfer of GlcNAc to the alpha-1,3 mannose of (Man)3(GlcNAc)2. We searched the fragmentation spectrum of the ion at m/z 1416.7 for the presence of cross ring fragments confirming the position of the added GlcNAc, distinguishing fragments for GlcNAc bound to the alpha-1,3 mannose have an expected [M+Na]+ mass of m/z 560.26. The corresponding cross ring fragments of GlcNAc bound to alpha-1,6 linked mannose have masses of m/z 546.25 and 574.28. Cross ring fragments distinguishing the linkage of terminal GlcNAc were not visible in the spectrum. Fragment ions present in the spectrum of m/z 1661.8 confirm the N-glycan structure $(GlcNAc)_2(Man)_3(GlcNAc)_2$ (FIG. 16).

N-glycan profiling of three different samples of *Leishmania tarentolae* using direct deglycosylation of intact proteins after delipidation of the cell pellets was performed. As already observed for previously analyzed wild type samples, cell pellet sample St10569 wild type contains only one N-glycan structure (Man)3(GlcNAc)2 (m/z 1171.6). Expression of GnT-I in sample St11707 genotype ssu::GnT-I showed both (Man)3(GlcNAc)2 (m/z 1171.6) and (GlcNAc)1(Man)3(GlcNAc)2 (m/z 1416.7). Gnt-I catalyzes the transfer of GlcNAc to the alpha-1,3 mannose of part of the (Man)3(GlcNAc)2 present on native glycoproteins. Co-expression of both Gnt-I and Gnt-II in St12320 genotype ssu::SfGnT-I; ssu::SfGnT-II leads to the presence of three distinct N-glycan types, (Man)3(GlcNAc)2 (m/z 1171.6), (GlcNAc)1(Man)3(GlcNAc)2 (m/z 1416.7) and (GlcNAc)2 (Man)3(GlcNAc)2 (m/z 1661.8). The additional expression of Gnt-II catalyses the transfer of a second GlcNAc residue to the alpha-1,6 mannose of (GlcNAc)1(Man)3(GlcNAc)2.

These data therefore confirm the in vivo activity of insect cell derived Gnts when heterologously expressed in *L. tarentolae* for their use in glycoengineering. Additionally, the presence of UDP-GlcNAc in the Golgi lumen is also implied and confirms the assumptions from the bioinformatic assessment of the activated nucleotide sugar transporter presence in native *L. tarentolae*.

These findings were confirmed when using GlycoWorks™ RapiFluor-MS™ to release and label N-glycans from strains St11707 and St12525, expressing either SfGnT-I alone or along with SfGnT-II, respectively, for which G0-Gn from SfGnT-I cells and G0 glycans (rom SfGnT-I+SfGnT-II cells were identified according to their m/z (FIG. 17A). St13065 co-expressed hMGAT1 and rMGAT2 and generated G0 glycan on its native secretory proteins, indicating that both Gnts were active in vivo (FIG. 17B).

Interestingly, of different variants of SfGnt-I having either an combination Strep-triple HA tag, only a Strep tag or having the native C-terminus, activities ranged from 20% to 75% on total N-glycans, respectively, indicating an negative impact of the C-terminal tag on the conversion of the paucimannose to NGA2-N (G0-Gn) in vivo (FIG. 47 B).

Heterologous Gnt-I candidates from the MGAT1 library, shown in Table 9, were therefore tested without any C-terminal tag. *Leishmania* expressing recombinant Gnt-I from different species converted the native Man3 N-glycans to G0-Gn. The activities ranged from very low efficiencies like 10% of the muMGAT1 (murine) to even more than 90%, as shown for DrMGAT1 (*Danio rerio*) or GjMGAT1 (*Gekko japonicus*) (FIG. 47 A).

The glycan derived from SfGnT-I activity leads to a G0-Gn glycan where the GlcNAc is added to the $\alpha$1,3 Man branch. St13066 was generated co-expressing SfGnT-I and hB4GALT1. The GlcNAc served as acceptor for the B4GALT1 in vitro (FIG. 14) and this activity was confirmed in vivo by the appearance of G1-Gn(a) with m/z=1587.63 as the peak at retention time 15.32 min (FIG. 17C).

This supports the choice of functional Gnts, additionally the availability of UDP-GlcNAc and UDP-Gal in the *Leishmania tarentolae* Golgi compartment as concluded from the bioinformatic assessment (Table 6). Glycoengineering in vivo was therefore confirmed in the novel *Leishmania tarentolae* host cells engineered and co-expressing Gnts for the production of function-customized N-glycans.

8.6 Example 6 Identification of Heterologous Glycosyltransferases that Elongate the Native Paucimannose N-Glycan on a Recombinant Human Erythropoietin In Vivo To assess the Gnt activity not only on native glycoproteins or secreted glycoproteins, a recombinant target protein human erythropoietin (hEPO) was co-expressed with GnT-I. EPO was expressed with two different signal peptides for secretory translocation to secretion into the supernatant. N-glycan release and site occupancy analyses by peptide mapping and MS were performed. The homogeneous paucimannose was confirmed on EPO when expressed in non-glycoengineered cells, while EPO co-expressed with GnT-I showed approximately 50% of N-glycans elongated with one GlcNAc, determined by N-glycan release and permethylation (FIG. 18).

Site occupancy was analyzed by tryptic peptide mapping (FIGS. 19 and 20). The enriched glycopeptide fractions of both EPO samples contain ions corresponding to occupied glycopeptide [EAENITTGCAEHCSLNENITVPDTK] (SEQ ID NO: 109) harboring glycosylation sites N24 and N38. In contrast no occupied glycopeptides corresponding to N83 are detectable. Both glycosylation sites on peptide [EAENITTGCAEHCSLNENITVPDTK](SEQ ID NO: 109) were occupied with N-glycans. EPO produced in wild type *Leishmania* tarentola strain St11521 contained only $(Man)_3(GlcNAc)_2$ core structures bound to both N-glycosylation sites. Co-expression of EPO and GnT-I in strain St11895 led to the occupation of N-glycosylation sites N24 and N38 with either $(Man)_3(GlcNAc)_2$ or $(GlcNAc)_1$ $(Man)_3(GlcNAc)_2$. In both EPO samples the glycopeptide [EAENITTG-CAEHCSLNENITVPDTK] (SEQ ID NO: 109) was not found with only one of the two N-glycosylation sides occupied by an N-glycan. Peptide [21-45][EAENITTG-CAEHCSLNENITVPDTK] (SEQ ID NO: 109) harboring N-glycosylation sites N24 and N38 has been found exclusively occupied with two N-glycans. In case of EPO produced in wild type *Leishmania* strain St11521 the ion at m/z 4588 corresponds to glycopeptide carrying two $(Man)_3$ $(GlcNAc)_2$N-glycans. EPO from strain St11895 showed in contrast three distinct glycopeptide ions: m/z 4588 corresponding to the glycopeptide carrying two $(Man)_3(GlcNAc)_2$N-glycans; m/z 4792 corresponding to the glycopeptide carrying one $(Man)_3(GlcNAc)_2$ and one $(GlcNAc)_1$ $(Man)_3$ $(GlcNAc)_2$ and m/z 4994 corresponding to the glycopeptide carrying two $(GlcNAc)_1$ $(Man)_3(GlcNAc)_2$ residues. For strain St11521 (rhEPO) wt EPO N-glycosylation sites N24 and N38 were exclusively occupied with (Man)3(GlcNAc)2 core N-glycans. For strain St11895 (rhEPO+SfgnT1) co-expression of EPO and GnT1 led to occupation of both sites with either (Man)3(GlcNAc)2 or (GlcNAc)1 (Man)3 (GlcNAc)2. No further N-glycopeptide ions harboring different N-glycan structures bound to these sites were observed.

The peptide [77-97] GQALLVNSSQPWEPLQLHVDK (SEQ ID NO: 156) harboring N-glycosylation site N83 could not be analyzed in this study since we did not find any clearly assignable peptide ions after trypsin digest of the proteins. It is thus not possible to draw conclusions on the occupation of site N83. Deglycosylation by PNGases did not reveal the presence of deglycosylated peptide [77-97] [GQALLVDSSQPWEPLQLHVDK] (SEQ ID NO: 156) harboring N-glycosylation site N83 as clearly identifiable ion. The theoretical monoisotopic mass of the deglycosylated peptide is 2360.24 Da. Spectra P2813 of St11895 and P2814 of St11521 contained very faint badly resolved ions at respectively m/z 2361.5 and 2360.01. It was not possible to confirm the identity of these ions by fragmentation. We thus have no confirmed indication of the presence of this peptide in its non-glycosylated or in its deglycosylated forms.

In both peptide mass fingerprints we do not find tryptic peptides [21-45] EAENITTGCAEHCSLNENITVPDTK (SEQ ID NO: 109) harboring N-glycosylation sites N24 and N38 or peptide [77-97] GQALLVNSSQPWEPLQLHVDK (SEQ ID NO: 156) harboring N-glycosylation site N83 in their non-glycosylated free form, indicating 100% N-glycosylation occupancy. No miss cleavages of these peptides were identified. Despite only 2 of the 3 N-glycosites were identified exclusively occupied 100%, we assume also the third site was occupied, which would correlate to an intact protein MS performed earlier on the EPO derived from non glycoengineered cells.

8.7 Example 7 Identification of Secretion Signals from Native Secreted Proteins Initially, the signal peptides were derived from an alkaline phosphatase from *Leishmania mexicana* described by (Klatt and Konthur 2012). In this invention, signal peptides were derived from secreted glycoproteins, by the native host cells that identified by using ConA purification and a subsequent proteomic approach and an EDMAN N-terminal sequencing. Among the identified glycoproteins secreted by the native host cells by MS, the most prominent proteins were invertase (sucrose hydrolase like protein) (LTAR_040008100.1; previous naming scheme: LtaP04.0290) and GP63 variants LTAR_100010400.1 (previous naming scheme: LtaPcontig00616-1) (FIG. 21), both containing N-glycosylation consensus sites and carrying the homogeneous Man3 paucimannose N-glycan. By EDMAN N-terminal sequencing, a putative secretion signal peptide from the invertase was identified: DGVPYEx (SEQ ID NO: 157) (FIG. 22). DGVPYEx (SEQ ID NO: 157) (+additional amino acids in the different cycles may have been possible: K in cycle 1, P in cycle 2, E in cycle 4). By genetic fusion of these corresponding nucleotides in frame to the hEPO nucleotide coding sequence, host cells recombinantly expressing C-terminally His or StrepII-tagged EPO were used to purify secreted recombinant EPO (FIG. 23).

8.8 Example 8 Targeting and Retaining to Correct Subcellular Compartment

As outlined in FIGS. 6 and 7, the sequential processing of N-glycans by glycosyltransferases takes place in the endoplasmic reticulum (ER) and the Golgi (Kellokumpu et al. 2016). The enzymes (glycosyltransferases and glycosidases) involved are traditionally thought to function separately one after the other by adding or removing sugar residues one at the time in a specified order to and from the growing oligosaccharide chain. This implies that the Gnts used for glycoengineering might be improved by a proper localization and retention along the secretory pathway. Most of the Golgi localized Gnts are type II membrane proteins with a short N-terminal cytoplasmic domain ("C"), an approximately 20 amino acid a-helical TM-domain ("T"), a stem domain ("S") and then the C-terminal globular catalytic domain in the lumen of the secretory pathway (FIG. 24A).

Their functional importance for glycosylation could also be based on their mutual interactions as homo- or heteromers. Their prevalence and the protein domains mediating these interactions could result in enzymatic activity changes that occur upon complex formation (Kellokumpu et al. 2016). Therefore hybrid-Gnts were designed for a) improved targeting and retaining to correct subcellular compartment (medial- and trans-Golgi, see FIG. 8) and b) homo- and heterodimerization enhancements leading to better activities for glycoengineering.

FIG. 24A shows the typical type II membrane proteins architecture, which we implied for a hybrid Gnt design, which is exemplified in FIG. 24B, where the predicted CTS of native Golgi proteins was genetically fused to the catalytic domain a heterologous GnT-x, in the following examples SfGnT-I. FIG. 24B shows expected *L. tarentolae* Golgi residing or associated proteins. *Trypanosoma* and *Leishmania* secretory signal sequences do not function in mammals; similar to Gram+ bacteria (Al-Qahtani et al. 1998) and signal peptide sequence requirements and cleavage sites appear different from trypanosomes and higher eukaryotes (La Flamme, A C et al. 1995). The organization of the trypanosomatid secretory pathway has been reviewed elsewhere (McConville et al. 2002b). *T. brucei* cell surface proteins (GPI-anchored) contain very conserved signal peptides for secretion (Böhme and Cross, George A M 2002). Targeting sequences for trans-Golgi network were shown to exist in *Trypanosoma brucei*, where the *T. brucei* GRIP domain, when fused to the C-terminus of the green fluorescent protein (GFP-TbGRIP), was efficiently localized to the Golgi apparatus of transfected COS cells. Moreover, these GRIP domain functioned in *T. brucei* and *Leishmania mexicana*, whereas in stationary phase *L. mexicana* the GRIP-trafficking decreased. GRIP proteins are described to usually have coiled-coil region, in GFP-GRIP fusion protein these are introduced from the extended GRIP region (McConville et al. 2002a). NTPDase, Nucleoside triphosphate diphosphohydrolase, hydrolyzes nucleotides, plays a role in parasite virulence and is associated to lipophosphoglycan (LPG) elongation. In *L. major*, the LmNTPDase1 is located in the Golgi, LmjF.15.0030 has a TM domain, presumably a CTS motif. The LmNTPDase 2 was shown to be secreted. LmjF.10.0170 has a predicted signal peptide (Sansom et al. 2014).

Homologues in *L. tarentolae* were identified as NTPDase1=LTAR_150005200.1 (previous naming scheme: LtaP15.0020) [best reverse hit on LmjF.15.0030] and the NTPDase2=LTAR_100006700.1 (previous naming scheme: LtaP10.0140) [best rev hit on LmjF.10.0170]. In contrast to *L. major*, both *L. tarentolae* NTPDase have a CTS domain. We set 5 amino acids for Active Region; 10 amino acids for CTS region for the fusion of the hybrid sequences. Length of stem region of CTS is generally ill defined, (Geisler et al. 2015b) used 13 amino acids after TM domain. The wt Gnts as well as hybrid structures (CTS of Man1-SfGnT-I Strep; CTS of LtaNTPDase1-SfGnT-I Strep; CTS of TbGnTI-SfGnT-II) were heterologously expressed in *L. tarentolae* and their localization was then analyzed by crude fractionation experiments. We also used the predicted CTS domain of a GnT-y, in following examples the human MGAT1, and fused different lengths to the recipient GnT-x, in the following examples SfGnT-I (FIG. 25). These plasmids (Table 10) were tested for localization (FIG. 46). By using increasing length of the MGAT1 N-terminal domain fused to an N-terminal decreasing SfGnt-I catalytic domain (FIG. 46 B), an improved cellular (membrane) localization was observed (FIG. 46 A). This consolidates the hypothesis of testing different N-terminal retention signals either from native Golgi localized proteins from *L. tarentolae* or from heterologous Golgi GnTs (as exemplified by using MGAT1 N terminal retention signals). However, the activity on N-glycan conversion was low and only detected in St13561 expressing construct 90MG1-SfGnT-I-3HA-Strep, due to the used Strep-triple HA tag, activity of native Sf GnT-I with Strep-triple HA tag was decreased around 10% when compared to Sf-GnT-I Strep tagged (FIG. 46 B).

TABLE 10

| Hybrids | | | |
|---|---|---|---|
| Exp ID | Description | Plasmid ID | Strain ID |
| P16_383_1 | 1_90MG1-SFGNT-I-3HA-Strep | p5825 | St13561 |
| P16_383_2 | 2_110MG1-SFGNT-I-3HA-Strep | p5826 | St13562 |
| P16_383_3 | 3_130MG1-SFGNT-I-3HA-Strep | p5827 | St13563 |
| P16_383_4 | 4_150MG1-SFGNT-I-3HA-Strep | p5828 | St13564 |
| P16_383_5 | 5_MGAT2-Strep-SFGNT1-3xHA | p5830 | St13566 |
| P16_407_9 | 9_MGAT2-Strep-MGhybrSFGNT1-3xHA | p5831 | St13567 |
| P16_383_6 | 6_SFGNT-I-3xHA-Strep native | p5829 | St13565 |
| P16_463_17 | 17_Stt3A_d90 SfGnt-I strep | p6173 | St14295 |

First we addressed the general growth of recombinant cell lines, expressing either recombinant human erythropoietin with a secretion peptide, or the SfGnT-I containing its native targeting signals. OD was monitored and cell shape changes followed by microscopy. Shaking culture reached higher OD and growth/expression peaked at 72 h but decreased at 96 h. Static culture reached a maximum growth and expression at OD of 1.8 at 96 h and the active production was prolonged. During growth the *L. tarentolae* cells displayed morphology related to cell cycle changes (G1>S>G2>M>G1 . . . ) (FIG. 26A). Expression and rough localization by separating crude cell pellets (whole cell extracts) and supernatant showed that EPO was primarily secreted and not retained inside the cell. Also the expected Golgi enzyme Sf-GnT-I was found in a truncated form in the supernatant, suggesting a potential proteolytic cleavage passaging through the secretory pathway or an CTS that is not suitable for retaining it in the Golgi of *L. tarentolae* (FIG. 26B). Furthermore, while SfGnT-I was also secreted to the SN, the *Trypanosoma* derived enzymes were found only in crude and Triton-X solubilized fractions, indicating a membrane and Golgi-localization (FIG. 27). TbGnT-I and TbGnT-II were mostly membrane associated (FIG. 27B). SfGnT-I was well active in vivo and in vitro, in contrast to Tb derived enzymes, we therefore used Sf-GnT-I as catalytic domain for the hybrid design. The CTS N-terminal regions described in FIGS. 24 and 25 were genetically fused to the predicted catalytic domain of Sf-GnT-I. Besides described CTS variants of FIG. 24B, also the TbGnT-I CTS could be used for N-terminally fusing to the catalytic domains of functional GnT-I or GnT-II enzymes. All CTS variants are imagined to be used for the catalytic domains of all active Gnts (GnT-I, GnT-II, GalT, SiaT) to generate functional and Golgi retained hybrid Gnts.

The localization of SfGnT-I full length and its CTS-hybrids are shown in FIG. 28. While the empty vector ctrl does not show any bands, the SfGnT-I-Strep (St11898) was detected by anti-Strep immunoblot in culture SNs of passage 3-passage 6 at the truncated size of 50 kDa with degradation at 38 kDa (double band), 30 kDa and 20 kDa but no bands detectable in lysate (+/−TrX) and insoluble cell debris. The CTS-Man1-SfGnT-I-Strep (St11899) was detected (aStrep) in SNs of p3-p6 at 47 kDa and degradations at 38 kDa (double band), 30 kDa and 20 kDa but no bands were detectable in lysate (+/−TrX) and insoluble cell debris. CTS-LtaNTPDase1-SfGnT-I-Strep (St11900) was not expressed or stable at all as it was neither detected in membrane fractions nor in SN. CTS-LtaNTPDase2-SfGnT-I-Strep (St11899) was detected as faint band in SN of p5, p6 at 47 kDa but no bands were detectable in lysate (+/−TrX) and insoluble cell debris. This indicated that localization was not changed as SfGnT-I seemed to have a proteolytically accessible site more towards the catalytic domain and the second strategy aiming for increments in the CTS were designed and tested (FIG. 25, Table 10, FIG. 46A, FIG. 47B). The cellular localization improved significantly in these incremented hybrids, supporting the hypothesis (FIG. 47A). However, the N-glycan conversion cannot be taken into account, first, because of a Strep-triple HA tag, which negatively impacted the activity when the native SfGntI was compared to SfGntI-Strepo and SfGnt-I Strep-3HA (FIG. 47B) and secondly, the 110 amino acid N-terminal truncation presumably also impaired the catalytic activity of SfGnT-I.

When testing a native human Gnt, St12239 expressing hMGAT1 3×HA tagged in p5 and p6, the hMGAT1 was detected in both, whole cell extract (WCE) and in SN. MGAT1 was also detected in cell debris (FIG. 29). This indicates secretion/release, but the in vitro active enzyme was predominantly purified from the membrane fractions and not from the SN (FIG. 11).

SfGnT-II expressed from St12318 at p10 (ssu::SfGnT-II-3×HA) was detected in WCE and in SN, being secreted/released at low levels. SfGnT-II was detected in TrX− lysate indicating cytosolic localization. However SfGNT-II was strongly detected in TrX+ lysate indicating membrane association (FIG. 30).

Relative strong expression rMGAT2 from St11897 in p5 and p6 (ssu::MGAT2-3×HA) was observed, with secretion of rMGAT2 to the SN, presence in whole cell extract and also intracellular/cytosolic localization of rMGAT2. rMGAT2 was also found strongly membrane bound in TrX+ lysates and insoluble fraction. Degradation at around 33-35 kDa was also observed (FIG. 31). rMGAT2 was purified from SN and $TrX^+$ pellets for in vitro activity tests (FIG. 12).

Therefore these novel hybrid strategies are necessary to support the retaining the heterologous and active Gnts in the *L. tarentolae* Golgi compartment.

8.9 Example 9 Sialic Acid Biosynthesis and Sialylation of the Biantennary N-Glycan In mammals and bacteria, anabolism and catabolism of Neu5Ac occurs through different pathways (Angata and Varki, 2002). Two main classes of enzymes can be used to form Neu5Ac. N-acetylneuraminate lyases (Neu5Ac lyase) is involved in the catabolism of sialic acids by catalyzing the cleavage of Neu5Ac into N-acetylmannosamine (D-ManNAc) and pyruvate in a reversible reaction. At high concentrations of D-ManNAc and pyruvate, the equilibrium can be shifted to the synthesis of Neu5Ac. Coupled to a glucosamine 2-epimerase activity, Neu5Ac lyase from *E. coli* can be used for the large-scale production of Neu5Ac from D-GlcNAc. Alternatively, Neu5Ac synthases, such as NeuB, can be used to catalyze the condensation of ManNAc onto phosphoenol pyruvate (PEP) and are directly involved in the biosynthesis of sialic acids (reviewed in Tanner, 2005). CgNal is an N-acetylneuraminic acid lyase from *Corynebacterium glutamicum* for production of Neu5Ac, it catalyzes the reversible aldol condensation of Neu5Ac from ManNAc and pyruvate but favors Neu5Ac synthesis not cleavage (Ji et al. 2015). The initial step in the mammalian sialylation pathway is the biosynthesis of the activated sugar nucleotide precursor CMP-Neu5Ac. To achieve the generation of this precursor from the endogenously present metabolite UDP-GlcNAc, the action of at least four enzymes can be used: (1) GNE, a bifunctional enzyme, which catalyzes the conversion of UDP-GlcNAc to ManNAc and the phosphorylation of ManNAc to ManNAc-6-phosphate; (2) NANS, which condenses ManNAc-6-phosphate and phosphoenolpyruvate, resulting in Neu5Ac-9-phosphate; (3) a specific phosphatase acting on Neu5Ac-9-phosphate; and (4) a CMAS that activates the resulting primary sialic acid in the nucleus to CMP-Neu5Ac (Castilho et al. 2010). Furthermore, bacterial NanE or GNPE (Geisler and Jarvis 2012) can further favor the precursorManNAc-6-phosphate formation from GlcNAc-6-phosphate (FIG. 53)

Suitable sialyltransferases (from Table 9) can be recombinantly expressed in *L. tarentolae* and affinity enriched from *L. tarentolae* crude lysates, membrane solubilized fraction, and media supernatants. The semi-purified enzymes (FIG. 49A) were then tested in vitro for their proper activity with co-factors and the activated sugar nucleotide precursor CMP-Neu5Ac. FIG. 48A shows the relative activity of *L. tarentolae* expressed sialyltransferases on a 2AB labeled G2 substrate in terms of transferring one sialic acid (=mono-antennary sialylation) or two sialic acids (bi-antennary sialylation) to the biantennary galactosylated substrate. Due to retention time comparisons (FIG. 49), the linkage determination on 2AB labeled glycans was evaluated and confirmed either as α2,6 or α2,3 linked sialic acid. FIG. 48B shows the relative amount in this screening assay. In a next approach, the main candidates (murine mST6GAL1) was tested on their activity on a fully folded monoclonal antibody (MabThera) (FIGS. 50A-50E). While mST6 extracted from lysates and affinity enriched (FIG. 50A) led to 100% biantennary α2,6 sialylation of the 2AB-labeled G2 substrate (FIG. 50B), the same enzyme preparation sialylated mainly one branch (~14%) and almost undetectable biantennary (0.4%) (FIGS. 50C and 50D). HA-elution of mST6 converted (sialylated) 14.2% of total N-glycan (~25% conversion of total galactosylated N-glycan); rSAP+HA-elution of mST6 converted (sialylated) 15.36% of total N-glycan (~26.5% conversion of total galactosylated N-glycan). Beads with capturing via HA-tag the mST6 (uneluted) converted (sialylated) 20.13% of total N-glycan (~34.7% conversion of total galactosylated N-glycan). 2 μM dCTP seem to inhibit the sialyltransferase activity (or enhance the sialidase activity) of HA-elution of mST6 resulting in only 4.12% conversion (sialylation) of total N-glycan (~6.9% conversion of total galactosylated N-glycan) (FIG. 50D). Take together, mST6 is able to in vitro sialylate the galactosylated N-glycan of MabThera in either free (eluted) or captured (beads form) and rSAP has slightly positive effect on ST-conversion and dCTP inhibits the ST conversion.

The host cell can be engineered to express a functional CMP-sialic acid (CMP-Sia) biosynthetic pathway. Mammalian biosynthesis and/or bacterial biosynthesis (Table 11) can be employed in *L. tarentolae* host cells, as previously performed in diverse other organisms like *Pichia*, insect cells and plants (Aumiller et al. 2003; Hamilton et al. 2006; Castilho et al. 2010). Once CMP-NeuAc is available in the Golgi of the *L. tarentolae* host cell, specific sialyltransferases can transfer sialic acid to the acceptor substrates (e.g. β1,4-galactosylated, diantennary N-glycan). Table 9 indicates the mammalian and bacterial Sialyltransferase and FIG. 53 shows the anticipated cellular localization of the biosynthesis pathway.

TABLE 11

| Sialic acid biosynthesis | | | | |
|---|---|---|---|---|
| Name | | Other names | accession number | species |
| GNE | UDP-GlcNAc 2-epimerase/ N-acetylmannosamine kinase | mGNE | Q91WG8.1 | *Mus musculus* |
| GNE | UDP-N-GlcNAc 2-epimerase/ N-acetylmannosamine kinase | hGNE | Q9Y223.1 | *Homo sapiens* |
| GNE/ MNK | UDP-N-GlcNAc 2-epimerase/ N-acetylmannosamine kinase | rGNE/ MNK | BC062011 | *Rattus norvegicus* |
| GNE/ MNK R263L- R266Q mutant | UDP-N-GlcNAc 2-epimerase/ N-acetylmannosamine kinase with point mutations from sialuria patient's GNE/MNK | GNE/ MNK- R263L- R266Q mutant | (Son et al. 2011) | *Rattus norvegicus* |
| NANS | N-acetylneuraminic acid phosphate synthase | hNANS | Q9NR45.2 | *Homo sapiens* |
| NANP | Neu5Ac-9-P phosphatase | hNANP | Q8TBE9.1 | *Homo sapiens* |
| CMAS | CMP-sialic acid synthetase | hCMAS | Q8NFW8.2 | *Homo sapiens* |
| CST | CMP-Neu5Ac transporter | hCST | P78382.1 | *Homo sapiens* |
| CST | CMP-sialic acid transporter | mCST | Q61420.2 | *Mus musculus* |
| neuA (siaB, synB) | CMP-sialic acid synthetase | neuA | WP_002215295 | *Neisseria meningitidis* |
| neuC (gne, synX) | UDP-N-acetylglucosamine 2-epimerase | neuC GNPE | WP_002226892 CAM09378.1 | *Neisseria meningitidis* |
| neuB (siaC) | CMP-sialic acid synthase | neuB | NP_273132.1 | *Neisseria meningitidis* |
| GNPE | N-acetylglucosamine-6-phosphate 2'-epimerase | NeuC_NnaA | AAY27727.1 | *Campylobacter jejuni* |
| CgNal | N-acetylneuraminic acid lyase favoring N-acetylneuraminic acid synthesis (Ji et al. 2015) | nanA | NP_601846.1 | *Corynebacterium glutamicum* ATCC13032 |

A method of engineering a CMP-Sia biosynthetic pathway into a non-human eukaryotic cell is provided. The method involves the cloning and expression of several enzymes of mammalian origin, bacterial origin or both, in a *L. tarentolae* host cell that lacks endogenous sialylation. The engineered CMP-Sia biosynthetic pathway is useful for producing sialylated glycolipids, O-glycans and N-glycans in vivo. This is thus useful for facilitating the generation of sialylated therapeutic glycoproteins in non-human host cells lacking endogenous sialylation.

The α2,3- or α2,6-sialyltransferase caps galactose residues with sialic acid in the trans-Golgi and trans Golgi network (TGN) of humans leading to a mature form of the glycoprotein. To engineer this processing step into a lower eukaryotic host cell and other host cells, which naturally lack sialyltransferase activity, the following can be incorporated into the host cell (1) α2,3- or α2,6-sialyltransferase activity and (2) a sufficient supply of CMP-N-acetyl neuraminic acid, in the late Golgi. To obtain sufficient α2,3- or α2,6-sialyltransferase activity in the secretory pathway (e.g. late Golgi), for example, the catalytic domain of a known sialyltransferase (e.g. from mammalian or bacterial origin) can be directed to the secretory pathway in lower eukaryotic host cells. Likewise, transporters can be engineered to allow the transport of CMP-N-acetyl neuraminic acid into the same location of the secretory pathway (e.g. late Golgi). Consequently, to ensure the adequate supply of substrate for the corresponding glycosyltransferases, one can metabolically engineer the production of CMP-sialic acid into these host cells. All analysis can be done as described previously in Examples 4 and 5.

8.10 Example 10 Anti-CD20 "Rituximab" Expression in *L. tarentolae*

As discussed before and schematically shown in FIGS. 1 and 2, improving the efficacy, reducing the therapeutic dosage and enhancing the overall clinical performance of the antibody by alterations by Fc glycans have prompted the design of a glycan repertoire to be chosen for different properties (FIG. 32). To test the concept in a potential application, an anti-CD20 monoclonal antibody, Rituximab, commercially available as MabThera® (Roche) was chosen as a test case for its known ADCC mode of action. FIG. 33 shows the amino acid sequence, the signal peptides and the discussed Asn 297 glycosite. FIG. 34 depicts the expression cassette integrated into *L. tarentolae* host cells. The resulting cell line St12427 was grown to harvest the secreted antibody molecule into the culture supernatant referred to as "Rituximab_LMTB". Purification was done using filtered supernatant in 2 steps, first a Protein A capturing purification followed by a Hydrophobic Interaction Column (FIG. 35).

FIG. 36A depicts the comparison of Rituximab_LMTB to the commercial comparator MabThera® from Roche. Under non-reducing conditions Rituximab_LMTB showed similar band pattern as MabThera® somehow in different intensities. Traces of degradation products were observed in both samples. PNGaseF digested proteins suggested a higher heterogeneity with more extended glycans in MabThera® than in the Rituximab_LMTB. The expected difference is shown in FIG. 36B. The capillary gel electrophoresis corroborated these observations (FIG. 37).

Aggregate formation of Rituximab_LMTB was determined with 5.8% compared to 0.3% of MabThera® using a MAbPac SEC-1, a size exclusion chromatography (SEC) column specifically for separation and characterization of monoclonal antibodies (FIG. 38).

Next, the N-glycan profiling using either Waters GlycoWorks™ RapiFluor-MS™ procedure (FIG. 39) or PNGaseF release and permethylation-followed by MALDI-TOF (FIGS. 40 and 41) was performed to address the heterogeneity of N-glycans and their fucose levels of MabThera® compared to Rituximab_LMTB. Indeed Rituximab_LMTB had 100% homogeneous Man3 glycan as compared to >8 glycoforms found in CHO produced antibody MabThera®. Quantitative comparison based on permethylation shown in FIG. 40, shows predominantly fucosylated structures, which are suboptimal for Fc mediated receptor function for ADCC. Indeed, Gazyvaro® Roche, the third generation anti-CD20 antibody, that was protein engineered as well as glycoengineered for ADCC, has already increased afucosylated N-glycans (FIG. 42). The permethylated N-glycan profiling of Gazyvaro® differs significantly from the profiles of Rituximab produced in *Leishmania tarentolae* and MabThera® from Roche. Dominant structures are bisecting N-glycans G0B, G0BF, G1B and G1BF. Fucosylation levels for Gazyvaro® are 52% as compared to 94% for MabThera®. In other words, Rituximab_LMTB produced in *Leishmania tarentolae* is 100% non fucosylated as compared to 48% for Gazyvaro® and only 6% for MabThera®. But Rituximab produced in *Leishmania tarentolae* showed only one structure corresponding to Man3 GlcNAc2 compared to 14 structures found for Gazyvaro® and 8 for MabThera®. The permethylated N-glycan profiling of commercial comparator MabThera® produced in CHO cells showed eight structures with the classical fucosylated biantennary structures, G0F and G1F as dominant structures.

This strongly supports the concept of glycoengineering for homogeneous and function-customized N-glycans in *Leishmania tarentolae* for therapeutic recombinant antibodies or Fc containing molecules.

Moreover, FACS staining was used to determine CD20 antigen binding capacity on Raji cells (FIG. 43A) and a dot blot analysis where recombinant CD20 was spotted and incubated with indicated antibodies (FIG. 43B); in both assays, Rituximab_LMTB was binding its antigen (CD20) comparably to MabThera®. Both antibodies give a clear, dose-dependent signal over the IgG1 control antibody in FACS, whereas the Mabthera signal appeared to be somewhat stronger.

FIG. 44 furthermore shows the schematic quality assessment performed, which is also listed in Table 12.

TABLE 12

| Rituximab quality criteria | | |
|---|---|---|
| | Rituximab_LMTB | MabThera_Roche |
| N-Glycosylation | Man3 (100%) | 8-11 Glycoforms and 94% core fucosylated |
| Disulfide Bonds | 16 out of 16 | 16 out of 16 |
| N-term HC | VSAAQ . . . and AQ . . . (parts on N-term signal peptide) | Q . . . |
| C-term HC | . . . GK | . . . G (Lysine clipped) |
| N-term LC | VSAAQ . . . ; AQ . . . and Q . . . (parts on N-term signal peptide) | Q . . . |
| C-term LC | . . . NRGEC | . . . NRGEC |

FIG. 52 shows the in vivo glycan extension from Man3 to G0 in a *Leishmania tarentolae* strain (St13418) that stably expressed the glycosyltransferases SfGnt-I Strep and MGAT2-HA; and episomally the Rituximab from pLMTB5026. Secreted Rituximab was then purified by protein A from a 2 d culture in a 1 L scale. 20 ug of purified Rituximab_LMTB was analyzed by PNGaseF and RF-MS, which showed that the glycoengineering in vivo was successful on the secreted target protein, a full-length monoclonal antibody.

8.11 Material and Methods

8.11.1 Strains, Growth and Genetic Methods

Strains (Table 13) were routinely grown in Brain Heart Infusion containing 5 ug/ml Hemin (BHIH) at 26° C. in the dark as static or shaking cultures for 2-3 d, if not otherwise indicated. Cultures of recombinant cell lines were containing the appropriate selective agents (Table 14).

TABLE 13

| Strains | | | |
|---|---|---|---|
| Strain | ID | Genotype | Transfection plasmid pLMTB |
| StLMTB | 10569 | WT Isolate 1 | / |
| StLMTB | 10616 | WT Isolate 2 | / |
| StLMTB | 11180 | ssu::EPO-His; ssu::TbGntI-3xHA | 3904, 4101 |
| StLMTB | 11209 | ssu::EPO-Strep; ssu::SfGnT1-Strep | 4123, 4239 |
| StLMTB | 11262 | WT Isolate 3 | / |
| StLMTB | 11357 | ssu::SfGnT-I-Strep | 4123 |
| StLMTB | 11384 | ssu::TbGnT-II-3xHA | 4117 |
| StLMTB | 11496 | ssu::TbGnT-I-3xHA | 4111 |
| StLMTB | 11707 | ssu::SfGnT-I-Strep | 4123 |
| StLMTB | 11895 | ssu::EPO-Strep, ssu::SfGnT-I-Strep | 4123, 4239 |
| StLMTB | 11897 | ssu:: rMGAT2-3xHA FL | 4575 |

TABLE 13-continued

| Strains | | | |
|---|---|---|---|
| Strain | ID | Genotype | Transfection plasmid pLMTB |
| StLMTB | 11898 | ssu:: SfGnT-I-Strep | 4577 |
| StLMTB | 11899 | ssu::CST Man1-SfGnT-I-Strep | 4578 |
| StLMTB | 11900 | ssu::CST LtaNTPDase1-SfGnT-I-Strep | 4579 |
| StLMTB | 12024 | ssu::SfGnT-II-Strep | 4695 |
| StLMTB | 12025 | ssu::CTS_TbGnTI1-SfGnT-II-Strep | 4697 |
| StLMTB | 12067 | ssu::CTS-SfGnT-II-3xHA | 4700 |
| StLMTB | 12068 | ssu::B4GALT1-Strep | 4703 |
| StLMTB | 12320 | ssu::SfGnT1-Strep_SfGnT-II-3xHA | 4123, 4700 |
| StLMTB | 12386 | ssu::hMGAT1-3xHA | 4939 |
| StLMTB | 12525 | ssu::SfGnT-I-Strep; ssu::SfGnT-II-3xHA | 4123, 4700 |
| StLMTB | 12767 | ssu::SfGnT-I-Strep; ssu::rMGAT2-3xHA | 4123, 5175 |
| StLMTB | 13063 | ssu::hMGAT1-3xHA; ssu::SfGnT-II-3xHA | 4939, 4700 |
| StLMTB | 13064 | ssu::hMGAT1-3xHA; ssu::B4GALT1-Strep. | 4703, 4939 |
| StLMTB | 13065 | ssu::hMGAT1-3xHA; ssu::rMGAT2-3xHA. | 4939, 5175 |
| StLMTB | 13066 | ssu::SfGnT-I-Strep; ssu::B4GALT1-Strep. | 4123, 4703 |
| StLMTB | 13086 | ssu::SfGnT-I-Strep; ssu::rMGAT2-3HA. | 4123, 5175 |
| StLMTB | 13418 | ssu::SfGnT-I-Strep; ssu::rMGAT2-3xHA. Episomal Rituximab p5026 | 4123, 5175; 5025 |
| StLMTB | 13556 | ssu::hST3GAL4-3xHA | 5849 |
| StLMTB | 13557 | ssu::hST6GAL1-3HA | 5851 |
| StLMTB | 13558 | ssu::mST3GAL3-3HA | 5843 |
| StLMTB | 13559 | ssu::mST6GAL1-3HA | 5845 |
| StLMTB | 13560 | ssu::rST6GAL1-3HA | 5847 |
| StLMTB | 13561 | ssu::90MG1-SfGnT1 cuo-3HA-Strep | 5825 |
| StLMTB | 13562 | ssu::110MG1-SfGnT1 cuo-3HA-Strep | 5826 |
| StLMTB | 13563 | ssu::130MG1-SfGnT1 cuo-3HA-Strep | 5827 |
| StLMTB | 13564 | ssu::150MG1-SfGnT1 cuo-3HA-Strep | 5828 |
| StLMTB | 13565 | ssu::SfGnT1 cuo-3xHA-Strep | 5829 |
| StLMTB | 13566 | ssu::MGAT2-Strep-trSFGNT1-3xHA | 5830 |
| StLMTB | 13567 | ssu::MGAT2-Strep-hybrSFGNT1-3xHA | 5831 |
| StLMTB | 13713 | ssu::LMSAP1 opti - cstI AAF13495-3HA | 5896 |
| StLMTB | 13714 | ssu::Spinv native - cstI AAF13495-3HA | 5897 |
| StLMTB | 13715 | ssu::Spinv opti - cstI AAF13495-3HA | 5898 |
| StLMTB | 13969 | ATCC_30287: *Phytomonas davidi* Lafont. Depositor: R B McGhee, Isolation: *Euphorbia heterophylla*, Ocochobee City, FL, 1975 | / |
| StLMTB | 13970 | ATCC 50166: *Phytomonas davidi* Lafont. Depositor: M Attias, Isolation: *Euphorbia hyssopifolia latex*, Rio de Janeiro, Brazil, 1983 | / |
| StLMTB | 14238 | ATCC - 30969: *Crithidia deanei* (*Angomonas*). Depositor: I Roitman, Isolation: *Zelus leucogrammus*, Goiania, Brazil, 1974 | / |
| StLMTB | 14239 | ATCC - PRA - 265: *Crithidia deanei* (*Angomonas*). Depositor: Dimitri Maslov. Isolation: Not available | / |
| StLMTB | 14290 | ssu::MmaMGAT1 (*Macaca mulatto*, untagged) | 6162 |
| StLMTB | 14291 | ssu::MmuMGAT1 (*Mus musculus*, untagged) | 6163 |
| StLMTB | 14292 | ssu::AgMGAT1 (*Anopheles gambiae*, untagged) | 6167 |
| StLMTB | 14293 | ssu::Ce14MGAT1 (*Caenorhabditis elegans* gly-14, untagged) | 6168 |
| StLMTB | 14294 | ssu::XtMGAT1 (*Xenopus tropicalis*, untagged) | 6172 |
| StLMTB | 14295 | ssu::Stt3-d90SFGNT1-Strep (Stt3-d90SFGNT1 fusion, Strep) | 6173 |
| StLMTB | 14296 | ssu::DrMGAT1b (*Danio rerio* B, untagged) | 6308 |
| StLMTB | 14362 | ssu::PtMGAT1 (*Pan troglodytes*, untagged) | 6161 |
| StLMTB | 14363 | ssu::GjMGAT1 (*Gekko japonicus*, untagged) | 6309 |
| StLMTB | 14585 | ssu::ClMGAT1 (*Canis lupus*, untagged). | 6306 |

TABLE 14

| Selective Agents | | | |
|---|---|---|---|
| Stock concentration | Selection marker gene leading to resistance | Final concentration (100%) | Pre-selection concentration (50%) |
| 100 mg/ml NTC (Nourseothricin) | sat | 100 ug/ml | 50 ug/ml |
| 100 mg/ml Geneticin | neo | 100 ug/ml | 50 ug/ml |

TABLE 14-continued

| Selective Agents | | | |
|---|---|---|---|
| Stock concentration | Selection marker gene leading to resistance | Final concentration (100%) | Pre-selection concentration (50%) |
| 50 mg/ml Paromomycin | neo | 300 ug/ml | 150 ug/ml |
| 100 mg/ml Zeocin (Bleomycin) | ble | 100 ug/ml | 50 ug/ml |
| 50 mg/ml Hygromycin | hyg | 100 ug/ml | 50 ug/ml |

TABLE 14-continued

| Selective Agents | | | |
|---|---|---|---|
| Stock concentration | Selection marker gene leading to resistance | Final concentration (100%) | Pre-selection concentration (50%) |
| 10 mg/ml Blasticidin | bsd | 10 ug/ml | 5 ug/ml |
| 10 mg/ml Puromycin | pac | 10 ug/ml | 5 ug/ml |

Transfections to generate stable cell lines were carried out as described below to integrate the heterologous gene of interest. The expression cassettes contain 1.) Homology sites for site specific integration by homologous recombination, 2.) an 5' untranslated terminal repeats containing a splice leader acceptor sequence, 3.) the gene of interest as ORF that was codon usage optimized for *Leishmania* (either *L. major* or *L. tarentolae*) 4.) an intergenic region that contains a 3'UTR for the polyadenylation sequence and a 5' UTR for the downstream gene, for example 5.) the resistance marker, that is followed by 6.) its 3' UTR and 7.) the 3' homology region for site specific recombination into the genome.

For integration into the genome 5-10 ug of donor plasmid DNA was digested with flanking restriction enzymes to excise the expression cassette from the vector backbone. The restriction digest was performed until completion or o/n at 30° C. and purified DNA by EtOH precipitation (2 volume 100% ice cold EtOH was added to 1 volume digested DNA, incubated 30 min on ice, centrifuged for 30 min 17'500×g at 4° C. Pellet was washed with 70% EtOH, pellet was dried for maximum 15 min and resuspended in ddH2O. For optimized removal of circularized plasmid, 1 or 2 restriction enzymes with recognition sites in the vector backbones were chosen and digest was done for around 1 h at 37° C. and purified by EtOH as described above.

Transformation of 100 ng digested DNA, undigested control and ddH2O control in *E. coli* DH5alpha was done by heat shock to check if there was remaining intact plasmid DNA. Chemically competent DH5alpha thawed on ice for 10-15 min were carefully mixed with 100 ng digested plasmid DNA, incubated on ice for 25-30 min followed by a heat shock at 42° C. for 90 sec, and incubated on ice for 5 min. 1 ml LB or SOC media was added with incubation at 37° C. for 1 h. Aliquots were then plated on LB with ampicillin and incubated o/n at 37° C. upside down.

Preparation of the *Leishmania* culture for transfection was done by a 1:10 dilution of a densely grown culture in BHIH the day before transfection, static at 26° C. The OD was measured at 600 nm with photometer in single-use cuvettes and ranged be between 0.4-1.0 (4-6×10*7 cells) for optimal efficiency. The cells should be in log-phase, which is indicated by a mixed population out of round and drop-like shaped cells. More round shaped cells were preferred. 10 ml culture was used for one transfection and one culture was always electroporated with ddH2O as negative control for the respective selection marker. For transfection the culture was spun at 1'800×g for 5 min, RT. The SN was removed and pellet resuspended in 5 ml transfection buffer (200 mM Hepes pH 7.0, 137 mM NaCl, 5 mM KCl, 0.7 mM Na2HPO4, 6 mM dextrose, anhydrous (glucose), sterile filtered 0.22 um). Cells were centrifuged again and the pellet was resuspended in 400 ul transfection buffer. 400 ul of cells were added to the DNA and transferred into the cuvettes and incubate on ice for 10 min. Electroporation was performed with a Gene Pulser Xcell™ (Biorad) using a low voltage protocol, exp. decay: 450V, 450 uF, 5-6 ms, cuvette: d=2 mm. Put immediately on ice for exact 10 min. The whole content of cuvette was transferred into 10 ml BHIH without any selection marker and cells were grown at 26° C. in dark, aerated, static for 20-24 h.

For the selection of a polyclonal cell line with subsequent clonal selection, half concentration of selection marker was added and cultures were incubated at 26° C. for 1-2 days, the passaged 1:10 in 10 ml BHIH+full concentration of selection marker. New strain numbers were assigned and passage number 0. The passage number of transfected strain was noted for all subsequent experiments. Cells were grown further at 26° C. in dark. If after 7 days cultures were turning into turbid culture, cells would be spun down at 1'800×g for 5 min at RT and pellet resuspended in new BHIH media containing full selection marker concentration.

For clonal selection, cells were streaked on BHIH plates (containing 1.4% agar) and the appropriate 100% selective agent as soon as the liquid culture turned turbid. Plates were sealed with parafilm and incubated 7-10 days upside down in dark at 26° C. Single colonies (1-2 mm size) were transferred into 24-well plates containing 1 ml BHIH, sealed with parafilm and incubated in dark at 26° C. for around 7-10 days. 1 ml culture was then transferred from 24-well plate into 10 ml BHI is a flask and further grown statically as usual.

Integrations at the genomics sites targeted was confirmed by PCR and sequencing.

8.11.2 Plasmids

Plasmids were derived from a pUC57 vector backbone for *E. coli* propagation and contained an ampicillin section marker. The expression cassettes are flanked by restriction sites suitable for excision. The cassettes contain 1.) Homology sites for site specific integration by homologous recombination, 2.) an 5' untranslated terminal repeats containing a splice leader acceptor sequence, 3.) the gene of interest as ORF that was codon usage optimized for *Leishmania* (either *L. major* or *L. tarentolae*) 4.) an intergenic region that contains a 3'UTR for the the polyadenylation and a 5' UTR for the downstream gene, for example 5.) the resistance marker, that is followed by 6.) its 3' UTR and 7.) the 3' homology region for site specific recombination into the genome. The plasmids were generated and sequenced by gene synthesis provider. Codon usage optimized for *Leishmania*, either from *L. major* found at http://www.kazusa.or.jp/codon/cgi-bin/showcodon.cgi?species=347515 or *L. tarentolae* on http://genomes.urv.es/OPTIMIZER/ using the following codon usage table:

GCA: 22.791; GCC: 29.220; GCG: 34.130; GCT: 19.986; TGC: 13.986; TGT: 6.059; GAC: 30.120; GAT: 17.499; GAA: 15.444; GAG: 43.653; TTC: 17.287; TTT: 12.657; GGA: 8.405; GGC: 27.204; GGG: 11.971; GGT: 14.274; CAC: 19.637; CAT: 8.559; ATA: 3.929; ATC: 17.100; ATT: 10.524; AAA: 18.838; AAG: 26.306; CTA: 6.293; CTC: 23.191; CTG: 32.564; CTT: 14.172; TTA: 2.836; TTG: 12.837; ATG: 23.282; AAC: 20.217; AAT: 7.912; CCA: 13.041; CCC: 12.627; CCG: 20.543; CCT: 10.758; CAA: 9.847; CAG: 30.402; AGA: 3.857; AGG: 6.046; CGA: 8.962; CGC: 26.322; CGG: 12.218; CGT: 12.622; AGC: 22.575; AGT: 9.528; TCA: 10.537; TCC: 16.057; TCG: 18.475; TCT: 12.894; ACA: 14.345; ACC: 16.949; ACG: 21.677; ACT: 9.877; GTA: 7.998; GTC: 16.924; GTG: 35.086; GTT: 10.582; TGG: 10.776; TAC: 18.379; TAT: 5.571; TAA: 0.366; TAG: 0.560; TGA: 0.719;

Optimized sequences were manually curated for avoidance of restriction sites and deletion of repeats or homopolymer stretches. Plasmids and descriptions are found in Table 15.

TABLE 15

| Plasmids | | |
|---|---|---|
| | ID | Description |
| pLMTB | 3904 | ssu::rhEPO-8His; sat marker (nourseothricin resistance) |
| pLMTB | 4101 | ssu::TbGnTI 3xHA; hyg marker (hygromycin resistance) |
| pLMTB | 4111 | ssu::TbGnTI 3xHA; hyg marker (hygromycin resistance) |
| pLMTB | 4117 | ssu::TbGnTII 3xHA; hyg marker (hygromycin resistance) |
| pLMTB | 4123 | ssu::SfGnT-I Strep; hyg marker (hygromycin resistance) |
| pLMTB | 4575 | ssu::rMGAT2 3xHA; hyg marker (hygromycin resistance) |
| pLMTB | 4239 | ssu::LMSAP1-rhEPO Strep; sat marker (nourseothricin resistance) |
| pLMTB | 4577 | ssu::SfGnT-I Strep; hyg marker (hygromycin resistance) |
| pLMTB | 4578 | ssu::CTS of Man1-SfGnT-I Strep; hyg marker (hygromycin resistance) |
| pLMTB | 4579 | ssu::CTS of LtaNTPDase1-SfGnT-I Strep; hyg marker (hygromycin resistance) |
| pLMTB | 4695 | ssu::SfGnT-II Strep; hyg marker (hygromycin resistance) |
| pLMTB | 4696 | ssu::SfGnT-II Strep; ble marker (zeocin resistance) |
| pLMTB | 4697 | ssu::CTS of TbGnTI-SfGnT-II Strep hyg marker (hygromycin resistance) |
| pLMTB | 4700 | ssu::SfGnT-II 3xHA; ble marker (zeocin resistance) |
| pLMTB | 4703 | ssu::B4GALT1 Strep; ble marker (zeocin resistance) |
| pLMTB | 4939 | ssu::hMGAT1 3xHA; hyg marker (hygromycin resistance) |
| pLMTB | 5175 | ssu::rMGAT2 3xHA; ble marker (zeocin resistance) |
| pLMTB | 5026 | ssu::Rituximab__LMTB sat marker (nourseothricin resistance) |
| pLMTB | 5825 | ssu::90MG1-SFGNT-I-3HA-Strep; hyg marker (hygromycin resistance) |
| pLMTB | 5826 | ssu::110MG1-SFGNT-I-3HA-Strep; hyg marker (hygromycin resistance) |
| pLMTB | 5827 | ssu::130MG1-SFGNT-I-3HA-Strep; hyg marker (hygromycin resistance) |
| pLMTB | 5828 | ssu::150MG1-SFGNT-I-3HA-Strep; hyg marker (hygromycin resistance) |
| pLMTB | 5829 | ssu::SFGNT-I-3xHA-Strep native; hyg marker (hygromycin resistance) |
| pLMTB | 5830 | ssu::MGAT2-Strep-SFGNT1-3xHA; hyg marker (hygromycin resistance) |
| pLMTB | 5831 | ssu::MGAT2-Strep-MGhybrSFGNT1-3xHA; hyg marker (hygromycin resistance) |
| pLMTB | 5843 | ssu::mST3GAL3-3HA; hyg marker (hygromycin resistance) |
| pLMTB | 5845 | ssu::mST6GAL1-3HA; hyg marker (hygromycin resistance) |
| pLMTB | 5847 | ssu::rST6GAL1-3HA; hyg marker (hygromycin resistance) |
| pLMTB | 5849 | ssu::hST3GAL4-3HA; hyg marker (hygromycin resistance) |
| pLMTB | 5851 | ssu::hST6GAL1-3HA; hyg marker (hygromycin resistance) |
| pLMTB | 5896 | ssu::LMSAP1 opti - cstI AAF13495-3HA; hyg marker (hygromycin resistance) |
| pLMTB | 5897 | ssu::SPinv native - cstI AAF13495-3HA; hyg marker (hygromycin resistance) |
| pLMTB | 5898 | ssu::Spinv opti - cstI AAF13495-3HA; hyg marker (hygromycin resistance) |
| pLMTB | 6161 | ssu::PtMGAT1; ble marker (zeocin resistance) |
| pLMTB | 6162 | ssu::MaMGAT1; ble marker (zeocin resistance) |
| pLMTB | 6163 | ssu::MuMGAT1; ble marker (zeocin resistance) |
| pLMTB | 6164 | ssu::RnMGAT1; ble marker (zeocin resistance) |
| pLMTB | 6165 | ssu::DrMGAT1a; ble marker (zeocin resistance) |
| pLMTB | 6166 | ssu::DmMGAT1; ble marker (zeocin resistance) |
| pLMTB | 6167 | ssu::AgMGAT1; ble marker (zeocin resistance) |
| pLMTB | 6168 | ssu::Ce14MGAT1; ble marker (zeocin resistance) |
| pLMTB | 6169 | ssu::Ce13MGAT1; ble marker (zeocin resistance) |
| pLMTB | 6170 | ssu::AtMGAT1; ble marker (zeocin resistance) |
| pLMTB | 6171 | ssu::OsJMGAT1; ble marker (zeocin resistance) |
| pLMTB | 6172 | ssu::XtMGAT1; ble marker (zeocin resistance) |
| pLMTB | 6173 | ssu::Stt3A__d90 SfGnt-I strep; ble marker (zeocin resistance) |
| pLMTB | 6306 | ssu::ClMGAT1; ble marker (zeocin resistance) |
| pLMTB | 6307 | ssu::BtMGAT1; ble marker (zeocin resistance) |
| pLMTB | 6308 | ssu::DrMGAT1b; ble marker (zeocin resistance) |
| pLMTB | 6309 | ssu::GjMGAT1; ble marker (zeocin resistance) |

8.11.3 the Gnt Candidates

The Gnts and additional Gnt hybrids are listed in Table 9 and Table 10.

8.11.4 N-Glycan Profiling Using Rapifluor (RF) Labelling and MS (a) Sample Preparation Samples were prepared following the Waters Application Note: «Quality control and Automation Friendly GlycoWorks RapiFluor-MS N-Glycan Sample Preparation». Briefly, sample amount was 10 µl, 1.5 mg/ml (15 µg) for purified protein samples or 10*8 cells as pellets. 3% RapiGest was added for 3 min at 100° C., 3 min at RT before adding 10 µl PNGase F (Sigma, diluted 30 µl PNGase+220 µl water) and incubated for 5 min at 50° C. After 3 min at RT 10 µl RFMS (9 mg in 110 µl DMF anhydrous) was added and incubated for 5 min at RT. 360 µl ACN was added and samples were cleaned by SPE cleanup with Elution in 3×30 µl and pooled to 90 µl. Before injection of 10 µl with Full Loop Injection (4× overfill factor), samples were diluted with 100 µl DMF and 210 µl ACN.

(b) Column Settings

Liquid chromatography was performed using a Glycan BEH Amide Column (Waters; 130 Å, 1.7 µm, 2.1 mm×150 mm) on a Waters Acquity UPLC system. The separation of the N-glycans was performed with a gradient starting at 20% of 0.1% formic acid (FA) in water (buffer A) and 80% of 0.1% FA in acetonitrile (buffer B) to 27% buffer A in 3 min and then within 32 minutes to 37% of buffer A at a flow rate of 0.5 mL/min. Detection was performed using an UV detector at 215 nm.

The UPLC was directly connected to a Waters Q-TOF Synapt HDMS for mass determination in ESI mode. Masses were acquired in the positive ion mode between m/z 300 and 3500" using a lock mass spray (Leucine Enkephaline) for lock mass correction.

ACQUITY UPLC Glycan BEH Amide 130 Å, 1.7 m, 2.1×150 mm; Buffers: A: 50 mM AmFor (H2O) pH 4.5, B: CAN; Flow: 0.5 ml/min; Temp: 45° C.; Inj.: 10 µl (Full Loop Injection); Gradient: 80-73% B in 3', 73-63% B in 32' (total 55 min), LC method ESI_RFMS_mAB_55_FLR; Synapt settings: 20161006_uba284_esi_RFMS), MS method ESI_RFMS_mAB_300_3500 vpos_55; Cap voltage: 3 kV; Cone voltage: 80V; Source temp: 120° C.; Desolv temp: 350° C.; Desolv gas: 800 l/h; Lock Mass: Leucine Enkephaline 1 ng/ul at flow rate 4 uL/min; Fluorescence detection: Ex 265/Em 425 nm (RapiFluor-MS) (2 Hz). 8.11.5 N-glycan profiling of crude cell pellets by permethylation and MALDI-TOF (a) Sample Preparation Pellets with 10*8 cells were delipidated with chloroform/methanol (2:1) for 30 min under shaking. After centrifugation a second delipidation step with chloroform methanol water (40:20:3) was performed for 30 min under shaking. After centrifugation the delipidated cell pellets were dried under a nitrogen flow.

Proteins of the cell pellets were extracted by 3×90 sec of sonication in 200 µl 50 mM ammonium bicarbonate buffer containing 0.1% Rapigest® SF (WATERS) and 10 mM DTT. Proteins were denatured at 56° C. for 45 minutes and alkylated by iodoacetamide (50 mM) in the dark for 60 minutes at room temperature. The samples were then incubated for 16 h, at 37° C. with 10 µg of trypsin/Lys-C Mix Mass Spec Grade (PROMEGA) to obtain the digested proteins.

(b) Glycosidase Digestion & Permethylation of N-Glycans

After 5 min at 95° C. to inactivate Trypsin/Lys-C, the samples were divided in two aliquots. One aliquot was deglycosylated with 20 units PNGase F (Promega #175715) and the second aliquot was deglycosylated with 15 µl PNGase A (Roche #10472620) adjusted to pH 5 with 200 mM acetate buffer pH 5. The 4 samples were incubated at 37° C., 16 h. The hydrolytic surfactant was removed by adding 0.5% TFA to the digested protein sample and incubated at 37° C. for 30 minutes and centrifugation at 15'000×g for 10 minutes. The tryptic peptides were loaded on SEP PACK C18 200 mg columns and the flow-throughs containing N-glycans were collected.

N-glycans were purified on Ultra Clean SPE Carbograph (ALLTECH). The SPE was equilibrated in 0.1% TFA before loading the PNGase released N-glycans and washed with 0.1% TFA. After elution with 3 ml of 25% acetonitrile, 0.1% TFA, the N-glycans were lyophilised before permethylation. Permethylation using about 25 mg of sodium hydroxide, 500 µl DMSO and 300 µl ICH3 was performed on the lyophilised samples during 40 min. After quenching the reaction with 1 ml of water, 3×500 µl of chloroform was used for the extraction of the permethylated glycans. The chloroform phase was washed with equal volumes of water then dried. The reaction products were loaded on C18 SepPak 200 mg (WATERS) and eluted in 2 ml 80% acetonitrile and lyophilised before MALDI-TOF MS analysis (c) MALDI-TOF Analysis of N-Glycans The purified permethylated glycans were solubilized in 20 µl of 50:50 methanol/water. 2 µl of non-diluted and 1/2 diluted N-glycans were mixed with 2 µl of 2,5 DHB (LaserBiolabs) matrix solution (10 mg/ml 50:50 methanol/water). Positive ion reflectron MALDI-TOF mass spectra were acquired using an Autoflex III mass spectrometer (Bruker). The spectra were obtained by accumulation of 4000 shots and were calibrated with an external standard (Pepmix4 LaserBiolabs). The acceleration and reflector voltage conditions were set up as follows: voltage 10.3×1954V, 80% laser.

8.11.6 Purification of Affinity Tagged Heterologous Gnts for In Vitro Activity Assays HA-Purification procedure was as follows. Culture of recombinant cells expressing heterologous Gnts was first analyzed for intracellular expression of the target HA-tagged Gnt enzyme. $1\times10^9$ cells were harvested and centrifuged (2000×g/5 min) to separate cell pellets for affinity purification. Pellet was resuspended in 1 mL Extraction Buffer (25 mM Tris pH 7.5, 100 mM NaCl, 1% v/v Triton X-100, Protease inhibitors without EDTA [Roche], 1 mM PMSF) containing 1% (v/v) Triton. Resuspended cells were sonicated on ice avoiding any kind of overheating! Sonication [Bandelin Sonopuls] was carried out in 3 steps for 20 sec, 70% power input, 7 cycles. Mix vigorously on vortexer for 10 sec. The suspension of disrupted cells was centrifuged at 13'000×g at 4° C. for 1 h. Supernatant (lysate) was carefully removed and used for purification. The remaining solid fraction was resuspended in 1× Laemmli and used for SDS-PAGE analysis. The lysate was mixed 1:2 with cold PBS (containing 1× Protease inhibitor tablets) and incubated with 100 µL anti-HA-magnetic beads [Thermo Scientific] at RT, 600 rpm for 30 min. HA-magnetic beads were harvested in 2 mL tube using magnetic rack [Thermo Scientific] and washed twice with 2 mL ice cold TBS. The elution was carried out with 70 µL Elution buffer (2 mg/mL HA peptide

[Thermo Scientific] in TBS). The elution fractions were analyzed on SDS-PAGE followed by anti-HA WB and used for in vitro activity assay.

StrepTactin-Purification procedure was as follows: Culture of recombinant cells expressing heterologous Gnts was analyzed for intracellular expression of the target Strep-tagged Gnt enzyme. $1\times10^9$ cells were harvested and centrifuged (2000×g/5 min) to separate cell pellets for affinity purification. Pellet was resuspended in 1 mL Extraction Buffer containing 1% (v/v) Triton. Resuspended cells were sonicated on ice avoiding any kind of overheating! Sonication [Bandelin Sonopuls] was carried out in 3 steps for 20 sec, 70% power input, 7 cycles. Mix vigorously on vortexer for 10 sec. The suspension of disrupted cells was centrifuged at 13'000×g at 4° C. for 1 h. Supernatant (lysate) was carefully removed and used for purification. The remaining solid fraction was resuspended in 1× Laemmli and used for SDS-PAGE analysis. The lysate was mixed 1:5 with cold PBS (containing 1× Protease inhibitor tablets) and incubated with 100 µL StrepTactin sepharose [VWR] at RT, 600 rpm for 30 min. 5-fold dilution in PBS was performed to reduce the interfering effect of cellular/media biotin on the StrepTactin purification efficacy. StrepTactin sepharose was collected in 2 mL tubes through centrifugation (2000×g/1 min) and washed twice with 2 mL cold TBS. The elution was carried out with 70 µL Elution buffer (2.5 mM Desthiobiotin in 1×TBS). The elution fractions were analyzed on SDS-PAGE followed by anti-Strep WB and used for in vitro activity assay.

8.11.7 In Vitro Glycosyltransferase Activity Assays, 2-Aminobenzamide (2AB) Labeling and/or Clean-Up of Glycans and HPLC Separation In vitro activity assay of HA-purified or Strepavidin-purified GNTs was performed with freshly prepared reagents added to a 1.5 ml tube on ice in following order: 1.50 ng of appropriate 2AB-labeled acceptor glycan (e.g. 2AB-Man3a [Prozymes]) OR 500 ng of appropriate unlabeled acceptor glycan (e.g. Man3a [Prozymes]); 10 mM MgCl2; 10 mM MnCl2; 1.2 mM activated sugar (e.g. UDP-GlcNAc or UDP-Gal [Sigma Aldrich]). Volumes were adjusted to 50 µL using TBS buffer (pH 8.0, 25 mM Tris pH 7.5, 100 mM NaCl); 20 µL HA-enriched or Streptavidin-enriched GNT enzyme was added or water for the corresponding MOCK control e.g. elution buffer only. Thereafter, the mixture was shortly spun down and incubated at RT, 600 rpm, o/n. In case of unlabeled substrate prior HPLC run the glycans were purified from the reaction mixture using Sep-Pak C18 classic cartridge [Waters]. Samples were labeled with 2-AB according to (Bigge et al. 1995). The glycan cleanup was performed using the paper disk method as described in (Merry et al. 2002). In case of 2AB-labeled substrate in the in vitro assay, PTFE clean-up was conducted prior HPLC run.

In vitro reactions for sialyltransferases using 2AB standards (Luley-Goedl et al. 2016) contained 4 µL containing 40 ng of 2AB-G2 (substrate sugar), 20 µL HA-enriched protein SiaT; 24 µL of 100 mM MES pH 6.5 (final 50 mM MES pH 6.5); 1 µL TritonX-100 solution (in 100 mM MES) to final 0.1% (v/v) TritonX-100 and 1 µL of 3.75 mM CMP-Neu5AC (dissolved in dH2O) stock solution (final 0.75 mM). The reactions were performed at 400 rpm at 37° C. for 12 h and cooled down at 4° C. and frozen at −20° C. until PTFE clean up and HPLC analysis. Further reactions were performed using MabThera as substrate.

In vitro activity assay for sialyltransferases using MabThera antibody was using 50 µg (5 µL) of commercial MabThera (Roche, in formulation buffer), 20 µL HA-enriched protein SiaT (containing 40 µg HA peptide in 100 mM MES deriving from elution buffer); 22 µL of 100 mM MES pH 6.5 (final ~100 mM MES pH 6.5); 1 µL TritonX-100 solution (in 100 mM MES) to final 0.1% (v/v) TritonX-100.1.5 mM CMP-Neu5Ac was added initially and 6 h later another 1.5 mM CMP-Neu5Ac boost resulting into final of 3 mM CMP-Neu5Ac. The reactions were performed at 400 rpm at 37° C. for 12 h and cooled down at 4° C. and frozen at −20° C. until N-glycan release by PNGaseF and RF-MS labeling (according to 6.11.4 N-glycan profiling using Rapifluor (RF) labelling and MS).

The separation of 2-AB labeled glycans was performed by HPLC using a GlycoSep-N normal phase column according to (Royle et al. 2002) but modified to a three solvent system. Solvent A was 10 mM ammonium formate pH 4.4 in 80% acetonitrile. Solvent B was 30 mM ammonium formate pH 4.4 in 40% acetonitrile. Solvent C was 0.5% formic acid. The column temperature was 30° C. and 2-AB labeled glycans were detected by fluorescence (λex=330 nm, λem=420 nm). Gradient conditions were a linear gradient of 100% A to 100% B over 160 min at a flow rate of 0.4 ml/min, followed by 2 min 100% B to 100% C, increasing the flow rate to 1 ml/min. The column was washed for 5 min with 100% C, returning to 100% A over 2 min and running for 15 min at 100% A at a flow rate of 1 ml/min, then returning the flow rate to 0.4 ml/min for 5 min. Samples were injected in water.

8.11.8 Expression and Purification of rhEPO from Non-Engineered and Glycoengineered Cell Lines 2×200 ml cultures for both strains were grown in BHIH 72 h at 26° C. shaking at 140 rpm. Cultures were harvested and centrifuged for 45 min at 2000×g. SN was harvested for ammonium sulphate precipitation. Briefly, SN was precipitated by $(NH_4)_2SO_4$ (40% W/V), for 45 min at RT prior to centrifugation at 11'000×g for 1 h at 4°. SN was removed and resuspended, dissolving remaining brown/black pellet in 50 ml 1×PBS pH 7.4. Dialysis was performed using 5 L PBS for 2 h and against 5 L o/n at 4° C. 50 ml dialyzed sample was loaded on 6 ml StrepTactin column. Washing was performed with 20 CV 1×PBS pH 7.4, 0.5 ml/min. Proteins were eluted using 10 CV with 2.5 mM desthiobiotin in 1×PBS in 1 ml fractions. Fractions were pooled and precipitated with cold aceton (−20° C.) added to pooled 4.5 ml elutions o/n at −20° C. Samples were centrifuged for 2 h at 8000 g and pellet was dissolved in 500 ul ddH2O

8.11.9 Determination of N-Glycosylation Site Occupation and Site Specific Glycosylation (a) Peptide Mass Fingerprint of rhEPO Rapigest® SF was used to enhance enzymatic digestion of the proteins in 50 mM ammonium bicarbonate. 180 µg of protein corresponding to 250 µL of each sample were prepared in 50 mM ammonium bicarbonate buffer, pH 8 by Vivaspin 500 PES (5 kDa) and four centrifugations (15'000× g; 10 min, 4° C.). The final concentration of the protein was about 3 mg/ml.

The protein was denatured in 0.1% Rapigest® SF, reduced by DTT (5 mM) at 60° C. for 45 minutes and alkylated by iodoacetamide (15 mM) in the dark for 45 minutes at room temperature according to Rapigest® SF protocol (WATERS). The sample was incubated for 16 hours, at 37° C. with 6.4 μg Trypsin/Lys-C Mix, Mass Spec Grade (Promega V507A #201254) to obtain the digested protein. The hydrolytic surfactant was removed by adding 0.5% TFA to the digested protein sample and incubated at 37° C. for 30 minutes and centrifugation at 15000 g for 10 minutes. All tryptic peptides were purified on SEP Pack C18, 200 mg (Waters) in 0.1% TFA in water. The elution volume, 2 mL of 70% acetonitrile, 0.1% TFA, was completely dried by lyophilisation.

(b) Glycopeptide Enrichment Method

Peptides were solubilized in 40 μL ultra-pure water and 30 μl were used for glycopeptide enrichment according to ProteoExtract® Glycopeptide Enrichment Kit protocol 72103-3 (Novagen).

30 μL of sample were added to 150 μL of ZIC Glycocapture Resin and the flow through containing non-bound peptides was collected. Glycopeptides were eluted with 225 μL ZIC Elution Buffer. The flow through and eluted samples were completely evaporated in speed vac. Glycopeptides were resuspended in 15 μL of MilliQ water. After purification on Zip Tips MILLIPORE C18 to improve the signal/noise ratio, the glycopeptide solution in 50% methanol was dried on maldi plate and 1 μl of CHCA (LaserBiolabs) matrix solution (7 mg/mL 50% acetonitrile) was added.

(c) Deglycosylation of the Enriched Fraction

Five μL of suspended glycopeptides were adjusted to 50 mM sodium acetate buffer and 1 μL of PNGase F (Promega V483A #226517) and 1 μL of PNGase A (Sigma #01000353) were added to deglycosylate during 16 hours at 37° C. The deglycosylated peptides after preparation on Zip Tips MILLIPORE C18 (SOP P17/2) were mixed with CHCA (1:1) (LaserBiolabs) matrix solution (7 mg/mL 50:50 acetonitrile/water, 0.1% TFA).

The flowthrough fractions were prepared and analysed with CHCA (1:1) (LaserBiolabs) matrix solution (7 mg/mL 50:50 acetonitrile/water, 0.1% TFA).

(d) MALDI-TOF MS Analysis

Peptides in the flow through fraction, deglycosylated glycopeptides and occupied glycopeptides were analysed by MALDI-TOF MS mass spectrometry in positive mode reflectron and linear modes. Linear mode MALDI mass spectra were acquired on MALDI-TOF/TOF Autoflex III (Bruker Daltonics). Acquisition conditions were: 14.3×2904V, laser 49%, 6000 shots. Positive ion reflectron MALDI mass spectra were acquired on MALDI-TOF/TOF Autoflex III (Bruker Daltonics) (SOP 44/1). Acquisition conditions with RP850-3500 Bruker method were 40×2160V; laser 97%, 5000 shots.

8.11.10 Peptide Mapping for Identification of *Leishmania tarentolae* Secreted Proteins St10569 cells were grown in 400 ml BHIH for 2 d at 26° C. in a shaking culture (140 rpm) to an OD of 3.4. Supernatants were harvested by centrifugation at 2000×g and stored at −80° C. until use. SN was thawn at 4° C. o/n, kept for 4 h at RT with protease inhibitor cocktail tablet (Roche, EDTA-free).

An Ammonium sulphate $(NH_4)_2SO_4$ precipitation was performed to precipitate secreted proteins. Briefly, 40 g $(NH_4)_2SO_4$ was added stepwise to the SNs (start concentration in percentage 10%). After addition of 160 g the samples were turbid and a last step of 40 g was done. Samples were incubated 40 min under stirring at RT. Centrifugation was performed at 11000×g at 4° C. for 30 min. Pellet was resuspended in 20 ml 1× Binding Buffer (1×TBS+1 mM $CaCl_2$+1 mM $MnCl_2$) ("1st SN"). Centrifugation was done at 4000×g for 15 min at 4° C. pellet only protein without BHIH leftovers. A small dark pellet observed, which was resuspended in 10 ml 1× Binding Buffer (1×TBS+1 mM $CaCl_2$+1 mM $MnCl_2$). SNs and resuspended pellets were dialyzed with 12-14K MWCO at 4° C. o/n in 1×TBS to remove the $(NH_4)_2SO_4$ Buffer was exchanged with freshly prepared 1×TBS and dialyzed with 12-14K MWCO further for 2.5 h at 4° C. 0.7 ml ConA column was prepared (1.4 ml slurry) for 1:50 ration of beads to sample 1 mM $CaCl_2$)+1 mM $MnCl_2$ was added to the sample of 2nd SN and filled up to 35 ml with 1× Binding Buffer for the "resuspended pellet" samples. ConA slurry was added to the sample and rotated for 4 h at RT. Centrifugation was done at 1000×g at RT for 5 min for all following steps. Flow through (FT) was collected and 100 ul were taken for SDS PAGE. Slurry was washed 4× with 2 CV binding buffer and wash fractions collected. The proteins were eluted over 6 CV with 1 CV (700 ul) while the first two elutions were incubated in eluting buffer (Vectorlab) for 10 min.

A peptide mapping was carried out using the following procedure. 5 μl Sample were mixed with 40 μl buffer (10 mM Tris/2 mM $CaCl_2$), pH 8.2) and 5 μl trypsin (100 ng/μl in 10 mM HCl) and treated in the microwave for 30 min at 60° C. Samples were dried, dissolved in 20 μl 0.1% formic acid, diluted 1:2 with 0.1% FA and transferred to autosampler vials for LC/MS/MS. 1 μl was injected for the measurement.

Database searches were performed using Mascot (swiss prot and uniref (all species), a database of the following fasta files in the search program.

TriTrypDB-26_LmajorFriedlin_AnnotatedProteins.fasta
TriTrypDB-26_LtarentolaeParrotTarII_AnnotatedProteins.fasta Additionally, a search was carried out against a custom database containing known proteomes of *Leishmania* and *Trypanosoma:*

Uniprot: *Trypanosoma brucei brucei* (strain 927/4 GUTat10.1); *Trypanosoma cruzi; Trypanosoma* cruzi marinkellei; *Trypanosoma vivax* (strain Y486); *Trypanosoma cruzi* Dm28c; *Trypanosoma rangeli* SC58; *Trypanosoma congolense* (strain IL3000); *Trypanosoma cruzi* (strain CL Brener); *Trypanosoma brucei gambiense* (strain MHOM/CI/86/DAL972); *Leishmania infantum; Leishmania major; Leishmania braziliensis; Leishmania mexicana* (strain MHOM/GT/2001/U1103); *Leishmania donovani* (strain BPK282A1).

TriTrypDB (http://tritrypdb.org/tritrypdb/): *Leishmania major* Friedlin; *Leishmania tarentolae* Parrot Tar II; *Trypanosoma brucei* Lister 427; *Trypanosoma cruzi* Dm28c. Total proteins: 155'504

Search results were summarized in Scaffold (if present, trypsin, keratin, other common contaminants, and decoy hits are hidden).

8.11.11 N-Terminal Sequencing for Identifying Signal Peptides

For N-terminal sequencing for signal peptide by EDMAN degradation, Con A enriched secreted proteins were further purified using a SEC 10/300 Superdex GL For this, 24 ml CV ConA elutions were pooled and concentrated to 500 ul with 3K MWCO Amicon filters in 1×PBS pH 7.4. SEC column was loaded with 0.5 ml/min flow rate, and fractions were collected in 0.5 ml volume. Several peaks observed in very low mAU range were observed and pooled. The pools were done in a way that the different peaks/proteins could be separated. Ultracentrifugation with Amicon 3K MWCO was performed to concentrate sample volume. Samples were loaded on SDS PAGE and blotted on PDVF membrane, stained with ponceau and protein bands were cut and subjected to EDMAN sequencing.

8.11.12 Evaluation of rhEPO Expression and Secretion with Different Signal Peptides Recombinant cell lines St 11376 and St11377 were grown each in 5×400 ml BHIH 1:40 over 3 days (72 h) at 26° C., 140 rpm. Supernatant was harvested after spin down at 2000×g for 40 min. Supernatant corresponding to 15 ODs was used for trichloroacetic acid (TCA) precipitation as follows: Supernatant was cooled down on ice, 100% TCA was added to final of 10% and incubated on ice for 15-30 min, centrifuged for 30 min at 11'000×g at 4° C., washed with 1 mL ice cold acetone, centrifuged for 30 min at 11'000×g at 4° C. Pellet was resuspended in 1× Laemmli (30 μL) and added up to 5 μL 1M TrisHCl (pH 8.0) to adjust pH (color indication yellow to blue). TCA precipitated supernatant containing secreted Strep-tagged rhEPO was used for WB and Coomassie analysis. 15OD SN TCA was loaded and run on 10% Bis-Tris Gels, at 200V with MOPS running buffer for 60 min. uDarpinLL was used as loading control with 2 ug for anti-Strep immunoblot and Coomassie. Blotting was performed with an Iblot™ (Invitrogen) PO for 7 min with 20-25V, membrane was subsequently blocked in 10% milk. Detection was performed using an polyclonal anti-Strep-tag II antibody, (rabbit, Abcam ab76949) at 1:1000 for 1 h at 30° C., followed by the secondary antibody goat anti rabbit HRP (Biorad, 170-6515) at 1:1000 for 1 h at 30° C. TMB was used for chromogenic detection. Coomassie staining was performed with o/n staining and ddH20 destaining o/n.

8.11.13 Bioinformatic Prediction of CTS Regions of Golgi Localized Proteins and Hybrid Design The used method for TM and Signal peptide prediction were: 1) http://phobius.sbc.su.se/Phobius (Käll, 2004), A Combined Transmembrane Topology and Signal Peptide Prediction Method); 2) Signal Peptide and transmembrane topology prediction based on HMM (A lower false positive rate than TMHMM and SignalP is claimed) and 3) SignalP. HMM was trained on 4 types of proteins: Transmembrane proteins with/without signal peptides Non-transmembrane proteins with/without signal peptides.

8.11.14 Purification of Affinity Tagged Heterologous Gnts for Subcellular Fractionation HA- or Strep-tagged GNT enzyme expressing cells ($1\times10^9$ corresponding to 50 OD) were harvest and centrifuged (4000×g/10 min) to separate SN from cell pellet. Supernatant (corresponding to 5 or 10 ODs) was used for TCA precipitation as follows: Supernatant was cooled down on ice, 100% TCA was added to final of 10% and incubated on ice for 15-30 min, centrifuged for 30 min at 11'000×g/4° C., washed with 1 mL ice cold acetone, centrifuged for 30 min at 11'000×g/4° C. Pellet was resuspended in 1× Lämmli (~30 μL) and added up to 5 μL 1M TrisHCl (pH 8.0) to adjust pH (color indication yellow to blue). TCA precipitated supernatant was used for WB analysis. The pellet was resuspended in 1 mL Extraction Buffer (ExB, 125 mM Tris pH 7.5, 100 mM NaCl, Protease inhibitors without EDTA [Roche], 1 mM PMSF) with or without 1% (v/v) TritonX-100. Resuspended cells were sonicated [Bandelin Sonopuls] on ice with avoiding any kind of overheating. Sonication was carried out in 3 steps for 10 sec, 70% power input, 7 cycles, mixed vigorously on vortex for 10 sec. Disrupted cell suspension was spun at 13'000×g at 4° C. for 1 h. Supernatant (lysate) was carefully removed and used as direct load (with 1× Laemmli) for Western blot analysis. The remaining pellets (+/−TritonX) were separately solubilized in 500 μL ExB supplemented with 1% (v/v) TritonX-100 using cell douncer [Sigma Aldrich] for better homogenization. Thereafter, the cell suspension was centrifuged at 13'000×g at 4° C. for 1 h. The soluble fraction was used as direct load (with 1× Laemmli) for WB analysis (termed as "insoluble fraction"). Optionally, the leftover pellet (termed cell debris) is resuspended in 1× Laemmli and used for WB analysis. All fractions were analyzed on SDS-PAGE following WB using the appropriate detection antibodies. The membrane association of the Gnts can be interpreted based on presence and intensity of WB bands in different fractions (e.g. supernatant, lysate+/−TritonX, cell debris).

Conditions for SDS PAGE were as follows: samples were heated in 1× Laemmli loading dye to 95° C. for 10 min; 10% Bis-Tris gels were run with MOPS Buffer at 200V for 60 min. Blotting was performed with an Iblot™ (Invitrogen) PO for 7 min with 20-25V, membranes were subsequently blocked in 10% milk. Detection was performed using either an polyclonal anti-Strep-tag II antibody, (rabbit, abcam ab76949) at 1:1000 for 1 h at 30° C. or an rabbit anti-HA tag antibody (Sigma, H6908) at 1:1000, followed by the secondary antibody goat anti-rabbit IgG HRP (Biorad, 170-6515) at 1:1000 or 1:2000, for 1 h at 30° C. TMB was used for chromogenic detection.

8.12 Anti-CD20 "Rituximab" Expression, Purification and Analysis in *L. tarentolae*

(a) Expression

5×1000 ml Cultures of St12427 (p13, p5026) were grown in BHIH for 72 h at 26° C. shaking at 140 rpm. Cultures were harvested and centrifuged for 15 min at 2000×g. 4 tablets of protease inhibitor cocktail (Roche) and EDTA (1 mM final concentration) were added to 5000 ml Media SN. 5000 ml media SN was filtered through 0.22 um filter prior to concentration with Vivaflow 200 (50'000 Da). Vivaflow was blocked using 100 ml BSA (2 g/L), after blocking, membrane was washed with 1 L ddH2O SN was concentrated 5 times to 1000 ml, flowrate vivaflow (600 ml/min).

(b) Purification

Media SN was loaded offline over night with peristaltic pump at 4° C. continuously on a 10 ml protein A Column. Column was connected to NGC System and Washed with 8 CV 1×PBS pH 7.4. Elution was performed with 0.15M Glycine pH 2.5 and directly neutralized by adding 150 ul 1M Tris pH 8.5. Pooled fractions (10 ml) containing rituximab were adjusted with 0.7 g $(NH_4)_2SO_4$ and loaded on a 1 ml HIC (PhenylSepharose GE) with a flow rate of 1 ml/min, and eluted with a Buffer A 20 mM Tris, 1M $(NH_4)_2SO_4$ pH 7.0 and Buffer B 20 mM Tris pH 7.0 gradient. 1000 ul Fraction were collected and analyzed by coomassie SDS PAGE and western blot.

(c) Analysis

SDS PAGE and Capillary Gel Electrophoresis: SDS PAGE was performed under reduced or non-reducing conditions using 10 ug for Coomassie, 2.5 ug for WB, separated on 4-12% Gel with MOPS buffer for 55 min. Determination of Protein purity was determined by Coomassie Stained SDS-PAGE with 10 ug protein sample and compared to a BSA standard curve. Impurities were quantified by ImageQuant. Capillary Gel Electrophoresis (CGE) was performed using an Agilent Protein 230 Kit (5067-1518), according to protocol.

Analytical SEC: MAbPac SEC-1 (4×300 mm) is a size exclusion chromatography (SEC) column specifically designed for separation and characterization of monoclonal antibodies (mAbs) and was used according to manufacture's recommendation (Temperature: 30° C.; Eluent: PBS 50 mM NaPO4, 300 mM NaCl pH 6.8; Elution: isocratic, 30 min; Flow: 0.2 mL/min; Detection: 215 nm; Injection V: 5 uL corresponding to 5 ug protein).

8.12.2 N-Glycan Profiling of Monoclonal Antibody Samples (a) Glycosidase Digestion & Permethylation of N-Glycans:

The IgG (200 μg/40 μl) was suspended in 200 μl of 50 mM phosphate buffer pH 7.5 and denatured in 0.5% sodium dodecyl sulfate (SDS Sigma L4509) and 1% β mercaptoethanol at 90° C. for 10 min. After adding 22 μl of NP40 in a final reaction volume of 484 μl the proteins were deglycosylated by enzymatic digestion 15 hours with 15 units of PNGase F (PROMEGA #226517 ref V483A) at 37° C. in phosphate buffer, pH 7.5. Deglycosylation was controlled by electrophoresis. 6.5 μl of sample before and after deglycosylation were heated during 10 min at 70° C. and loaded on NuPAGE® Novex Bis-Tris 4-12% Gel, 1.0 MM, 12 w (Invitrogen) in NuPAGE® MES Buffer (Invitrogen NP0002)+antioxydant agent. Run time 35 min at 200 V constant. The gel was stained with Simply BlueSafestain (Invitrogen) during 1H and destained in water.

N-glycans were purified on Hypercarb Hypersep 200 mg (Thermo Fisher). The SPE was equilibrated in 0.1% TFA before loading the PNGase released N-glycans and washed with 0.1% TFA. After elution with 3 ml of 25% acetonitrile, 0.1% TFA, the N-glycans were lyophilised before permethylation. Permethylation using about 25 mg of sodium hydroxide, 500 μl DMSO and 300 μl ICH3 was performed on the lyophilised samples during 40 min. After quenching the reaction with 1 ml of water, 3×500 μl of chloroform was used for the extraction of the permethylated glycans. The chloroform phase was washed with equal volumes of water then dried. The reaction products were loaded on C18 SepPak 200 mg (WATERS) and eluted in 2 ml 80% acetonitrile and lyophilised before MALDI-TOF MS analysis.

8.12.3 MALDI-TOF Analysis of N-Glycans

The purified permethylated glycans were solubilized in 20 μl of 50:50 methanol/water. 2 μl of non-diluted and 1/2 diluted N-glycans were spotted with 1 μl of CHCA (LaserBiolabs) matrix solution (7 mg/ml 50:50 acetonitrile/water). Positive ion reflectron MALDI-TOF mass spectra were acquired using an Autoflex III mass spectrometer (Bruker). The spectra were obtained by accumulation of 4000 shots and were calibrated with an external standard (Pepmix4 LaserBiolabs). The acceleration and reflector voltage conditions were set up as follows: voltage 14.7×2008V, 80% laser.

Interpretation of N-glycan structures corresponding to monoisotopic masses [M+Na]+ was performed using EXPAZY GlycoMod tool. Relative intensities (%) of N-glycans were calculated to establish N-glycan profiles for each spectrum. For this the sum of intensities of deisotoped N-glycan peaks was determined and set as 100%. The relative intensity (%) of each glycan was then determined in relation to this value.

8.12.4 FACS

Raji cells were used for anti-CD20 antibody test. There were 5 different concentrations foreseen, using 10 microgram/ml as the expected optimal concentration for flow cytometry (Table 16). Staining sequence:—FcR blocking,—IgG1 blocking,—Primary antibody,—Secondary antibody anti-IgG1 APC. After gating, each sample represents analysis of 10000-13000 cells. Control IgG1 antibody also gives some signal. Reasons could be unsufficient blocking and binding through Fc-receptors, or binding through its specificity—the specificity of the control antibody is unknown, although it is commonly used for this purpose. Blocking controls show that FcR blocking on its own actually causes a low background signal, reversed again by the second blocking step with unlabeled anti-human-IgG1 (not shown).

Analysis of anti-CD20 antibody using Raji cells, that were collected from culture flask, by spinning 5 min at 150×g (790 rpm Hettich Rotixa RP Rotor 4210), supernatant was removed completely and cells were resuspended cells in wash buffer (DPBS w/o Ca++/Mg++, add to 2% fetal calf serum, stored at 4° C.; DPBS w/o Ca++/Mg++, Corning 21-031-CMR, Lot 21031494R) at $10^7$ cells per 80 μl wash buffer, add 20 μl FcR Blocking Reagent. Incubation was done for 10 min at 4° C. in the dark. Wash was performed by adding 1.4 ml D-PBS per $10^7$ cells, spin cells 5 min at 250×g (1750 rpm Eppendorf 5415C), supernatant was removed completely.

Cells were resuspended in 80 μl DPBS per $10^7$ cells, 20 μl anti-human-IgG1 pure (=20 μg/ml) was added, incubated 10 min in the refrigerator in the dark, washed by adding 1.4 ml wash buffer per $10^7$ cells, cells spun 5 min at 250×g, supernatant was removed completely. Cells were resuspended in 20 μl wash buffer per $2×10^6$ cells, add primary antibody was added according to samples schedule below, incubated for 10 min in the refrigerator in the dark, washed by adding 0.7 ml wash buffer per $10^7$ cells, cells spun 5 min at 250×g, supernatant was removed completely. Cells were resuspend in 20 μl wash buffer per $2×10^6$ cells, 2 μl secondary antibody anti-human-IgG1-APC was added according to samples schedule below, incubated for 10 min in the refrigerator in the dark, washed by adding 0.7 ml wash buffer per $10^7$ cells, cells spun 5 min at 250×g, supernatant was removed completely. Cells were resuspended in 300 μl wash buffer, kept on ice until analysis by flow cytometry. Reagents were used as follows: FcR Blocking Reagent, Miltenyi 130-059-901, Lot 5170330778; anti-human-IgG1 pure (100 μg in 1 ml), Miltenyi 130-093-197, Lot 5170426031; anti-human-IgG1-APC, Miltenyi 130-099-126, Lot 5170426074.

TABLE 16

Sample preparations for FACS

| Sample | FcR blocking reagent | anti-human-IgG1 pure | Primary Antibody | Primary Antibody conc. μg/ml | Primary Antibody 50 μg/ml + wash buffer | anti-human IgG1-APC 1:11 |
|---|---|---|---|---|---|---|
| 1 | − | − | − | − | − | − |
| 2 | − | − | − | − | − | + |
| 3 | − | + | − | − | − | + |
| 4 | + | − | − | − | − | + |
| 5 | − | − | control IgG1 | 10 | 5 + 20 μl | + |
| 6 | − | + | Control IgG1 | 10 | 5 + 20 μl | + |
| 7 | + | − | control IgG1 | 10 | 5 + 20 μl | + |
| 8 | − | − | Mabthera | 10 | 5 + 20 μl | + |
| 9 | − | + | Mabthera | 10 | 5 + 20 μl | + |
| 10 | + | − | Mabthera | 10 | 5 + 20 μl | + |
| 11 | − | − | rituximab | 10 | 5 + 20 μl | + |
| 12 | − | + | rituximab | 10 | 5 + 20 μl | + |
| 13 | + | − | rituximab | 10 | 5 + 20 μl | + |
| 14 | + | + | control IgG1 | 10 | 5 + 20 μl | + |
| 15 | + | + | Mabthera | 2.5 | 1.25 + 23.75 | + |
| 16 | + | + | Mabthera | 5 | 2.5 + 22.5 | + |
| 17 | + | + | Mabthera | 10 | 5 + 20 μl | + |
| 18 | + | + | Mabthera | 20 | 10 + 15 μl | + |
| 19 | + | + | Mabthera | 40 | 20 + 5 μl | + |
| 20 | + | + | rituximab | 2.5 | 1.25 + 23.75 | + |
| 21 | + | + | rituximab | 5 | 2.5 + 22.5 | + |
| 22 | + | + | rituximab | 10 | 5 + 20 μl | + |
| 23 | + | + | rituximab | 20 | 10 + 15 μl | + |
| 24 | + | + | rituximab | 40 | 20 + 5 μl | + |

Dot-Blot:

5-1000 ng CD20-GST (Proteintech, #ag17309) blotted on NC-Membrane with DotBlot manifold, Blocked o/n at 4° C. 10% Milk/PBST. Lanes were cut and incubated with 5 ug/ml Rituximab_LMTB, MabThera®, 2 ug/ml AntiGoEL, 2 ug/ml AntiMBP., 1:2000 Anti-His in PBST 1% Milk at RT for 2 h. Lanes washed, 3×5 min PBST and incubated with Anti-Human-IgG-HRP (1:2000) or anti-mouse for 1 h at RT in PBST 1% Milk. Lanes were washed for 3×5 min with PBST and blot was developed using TMB.

Rituximab EDMAN Degradation, IP-MS and Peptide Mapping:

Sample preparation and analysis was performed as follows:

Reduction, alkylation: solubilization in 8M urea, 50 mM TEAB buffer, reduction by 5 mM TCEP and incubation at RT for 20 min. Alkylation with 10 mM IAA and incubation at RT for 20 mins in the dark.

Deglycosylation: After alkylation the antibody sample was diluted 1:10 by addition of PNGase F enzyme buffer. 0.5 μl of PNGase F was added for 25 μg of antibody. The sample was further incubated at 37° C. for 1 h.

SDS-PAGE: The alkylated and deglycosylated antibody sample was solubilized in Lämmli buffer. Aliquots of 5 μg sample were loaded onto an SDS-PAGE gel. After the gel run (150 V, max. 400 mA, 75 min) the gel was incubated in 50% ethanol, 10% acetic acid for 30 min prior to gel staining with Coomassie Brilliant Blue.

In-gel enzymatic cleavage: Gel slices from SDS-PAGE gels were prepared for enzymatic cleavage by 3 times swelling/shrinking in 100 mM TEAB or 50 mM TEAB, 60% ACN respectively. Each step was carried out for 30 min at RT. After the last shrinking step the gels slices were dried in open eppys for 15 min. Proteolysis was started by adding 3 volumes of enzyme solutions with a enzyme/protein ratio of 1:40. Proteolysis was carried out overnight. The resulting peptides were acidified with 0.5% (final) formic acid prior to mass spectrometry.

Intact mass determination: The deglycosylated and reduced antibody was used for intact mass determination of it's subchains after dilution to ca. 1 pmol/μl (1:50) with 0.5% ACN, 0.5% FA and 5 μl were applied to the mass spectrometer by a LC-system. Detection was done with the LTQ and FT detector of a Thermo Scientific Orbitrap XL mass spectrometer. Charge deconvolution was done using the Znova algorithm.

High resolution MS: The Agilent 1100 nanoLC system was coupled to an Orbitrap XL mass spectrometer. Samples from proteolyses were applied to nanoLC-ESI MS/MS after acidification. After trapping and desalting the peptides on enrichment column (Zorbax SB C18, 0.3 mm×5 mm, Agilent) using 0.5% ACN/0.5% FA solution for 5 min, peptides were separated on Zorbax 300 SB C18, 75 m×150 mm column (Agilent) using an ACN/0.1% FA gradient from 5% to 40% ACN. MS overview spectra were automatically taken in FT-mode according to manufacturer's instrument settings for nanoLC-ESI-MSMS analyses. Peptide fragmentation (CID) and detection also operated in FT-mode.

Database search: Data sets acquired by high-resolution mass spectrometry were used for database searches against a custom database of the sequences provided by the client. The search parameters were set according to the expected protein modifications and to the MS instrument used in this study. Sequence assembly was accomplished by PEAKS (Bioinformatics solutions) software with respect to the given enzyme specificities.

6.13 Genome Sequencing and Annotation (a) Sequencing and Sequence Correction

St10569 genomic DNA was sequenced on 12 PacBio RS2 SMRT cells (v3.0 P6/C4 chemistry, library preparation according to the manufacturer's specification and size selected at 8-9 kbp) and Illumina HiSeq (2×150 bp paired-end sequencing; TruSeq library preparation according to the manufacturer's specification into 400-600 bp fragments). The resulting raw data consists of 6M PacBio reads with a mean read length of 6549 bp and 14M Illumina reads.

PacBio raw reads were assembled into long contigs using HGAP [https://github.com/PacificBiosciences/Bioinformatics-Training/wiki/HGAP-in-SMRT-Analysis] and error corrected using two rounds of Arrow [https://github.com/PacificBiosciences/GenomicConsensus]. Abacas2 (Assefa et al. 2009) was used to scaffold the resulting contigs along a reference genome based on *Leishmania donovani* (Dumetz et al. 2017) (minimal overlap 1000 bp, minimal identity 15%). PBjelly (English et al. 2012) was used to attempt to close remaining gaps based on PacBio polished reads larger than 1 kb. Five rounds of Pilon polishing (Walker et al. 2014) based on the Illumina data was performed to correct remaining sequencing errors in the resulting chromosomal scaffolds.

(b) Annotation

The polished chromosomal scaffolds were annotated using Companion (Steinbiss et al. 2016) based on the annotated genome of *Leishmania major* strain Friedlin (Ivens et al. 2005) as reference.

PUBLICATION BIBLIOGRAPHY

Aebi, Markus (2013): N-linked protein glycosylation in the ER. In *Biochimica et Biophysica Acta (BBA)—Molecular Cell Research* 1833 (11), pp. 2430-2437. DOI: 10.1016/j.bbamcr.2013.04.001.

Al-Qahtani, A.; Teilhet, M.; Mensa-Wilmot, K. (1998): Species-specificity in endoplasmic reticulum signal peptide utilization revealed by proteins from *Trypanosoma brucei* and *Leishmania*. In *The Biochemical journal* 331 (Pt 2), pp. 521-529.

Aumiller, Jared J.; Hollister, Jason R.; Jarvis, Donald L. (2003): A transgenic insect cell line engineered to produce CMP-sialic acid and sialylated glycoproteins. In *Glycobiology* 13 (6), pp. 497-507. DOI: 10.1093/glycob/cwg051.

Bigge, J. C.; Patel, T. P.; Bruce, J. A.; Goulding, P. N.; Charles, S. M.; Parekh, R. B. (1995): Nonselective and efficient fluorescent labeling of glycans using 2-amino benzamide and anthranilic acid. In *Anal Biochem* 230 (2), pp. 229-238.

Böhme, Ulrike; Cross, George A M (2002): Mutational analysis of the variant surface glycoprotein GPI-anchor signal sequence in *Trypanosoma brucei*. In *J Cell Sci* 115 (Pt 4), pp. 805-816.

Breitling, Reinhard; Klingner, Susanne; Callewaert, Nico; Pietrucha, Regina; Geyer, Anett; Ehrlich, Gunter et al. (2002): Non-pathogenic trypanosomatid protozoa as a platform for protein research and production. In *Protein Expr. Purif.* 25 (2), pp. 209-218. DOI: 10.1016/S1046-5928(02)00001-3.

Calow, Jenny; Behrens, Anna-Janina; Mader, Sonja; Bockau, Ulrike; Struwe, Weston B.; Harvey, David J. et al. (2016): Antibody production using a ciliate generates unusual antibody glycoforms displaying enhanced cell-killing activity. In *mAbs* 8 (8), pp. 1498-1511. DOI: 10.1080/19420862.2016.1228504.

Capul, A. A.; Barron, T.; Dobson, D. E.; Turco, S. J.; Beverley, S. M. (2007): Two Functionally Divergent UDP-Gal Nucleotide Sugar Transporters Participate in Phosphoglycan Synthesis in *Leishmania major*. In *Journal of Biological Chemistry* 282 (19), pp. 14006-14017. DOI: 10.1074/jbc.M610869200.

Castilho, A.; Strasser, R.; Stadlmann, J.; Grass, J.; Jez, J.; Gattinger, P. et al. (2010): In Planta Protein Sialylation through Overexpression of the Respective Mammalian Pathway. In *Journal of Biological Chemistry* 285 (21), pp. 15923-15930. DOI: 10.1074/jbc.M109.088401.

Chen, Chia-Lin; Hsu, Jen-Chi; Lin, Chin-Wei; Wang, Chia-Hung; Tsai, Ming-Hung; Wu, Chung-Yi et al. (2017): Crystal Structure of a Homogeneous IgG-Fc Glycoform with the N-Glycan Designed to Maximize the Antibody Dependent Cellular Cytotoxicity. In *ACS Chem. Biol.* DOI: 10.1021/acschembio.7b00140.

Chung, Shan; Quarmby, Valerie; Gao, Xiaoying; Ying, Yong; Lin, Linda; Reed, Chae et al. (2012): Quantitative evaluation of fucose reducing effects in a humanized antibody on Fcγ receptor binding and antibody-dependent cell-mediated cytotoxicity activities. In *mAbs* 4 (3), pp. 326-340. DOI: 10.4161/mabs.19941.

Costa, Ana Rita; Rodrigues, Maria Elisa; Henriques, Mariana; Oliveira, Rosário; Azeredo, Joana (2014): Glycosylation: impact, control and improvement during therapeutic protein production. In *Critical reviews in biotechnology* 34 (4), pp. 281-299. DOI: 10.3109/07388551.2013.793649.

Cox, Kevin M.; Sterling, Jason D.; Regan, Jeffrey T.; Gasdaska, John R.; Frantz, Karen K.; Peele, Charles G. et al. (2006): Glycan optimization of a human monoclonal antibody in the aquatic plant *Lemna minor*. In *Nat. Biotechnol.* 24 (12), pp. 1591-1597. DOI: 10.1038/nbt1260.

Damerow, Manuela; Graalfs, Frauke; Guther, M. Lucia S.; Mehlert, Angela; Izquierdo, Luis; Ferguson, Michael A. J. (2016): A Gene of the β3-Glycosyltransferase Family Encodes N-Acetylglucosaminyltransferase II Function in *Trypanosoma brucei*. In *Journal of Biological Chemistry* 291 (26), pp. 13834-13845. DOI: 10.1074/jbc.M116.733246.

Damerow, Manuela; Rodrigues, Joao A.; Di Wu; Guther, M Lucia S; Mehlert, Angela; Ferguson, Michael A J (2014): Identification and functional characterization of a highly divergent N-acetylglucosaminyltransferase I (TbGnTI) in *Trypanosoma brucei*. In *THE JOURNAL OF BIOLOGICAL CHEMISTRY* 289 (13), pp. 9328-9339. DOI: 10.1074/jbc.M114.555029.

Dicker, Martina; Strasser, Richard (2015): Using glyco-engineering to produce therapeutic proteins. In *Expert Opin Biol Ther* 15 (10), pp. 1501-1516. DOI: 10.1517/14712598.2015.1069271.

Dimitrov, Dimiter S. (2012): Therapeutic proteins. In *Methods Mol. Biol.* 899, pp. 1-26. DOI: 10.1007/978-1-61779-921-1_1.

Elliott, S.; Lorenzini, T.; Asher, S.; Aoki, K.; Brankow, D.; Buck, L. et al. (2003): Enhancement of therapeutic protein in vivo activities through glycoengineering. In *Nat Biotechnol* 21 (4), pp. 414-421.

Eon-Duval, Alex; Broly, Herve; Gleixner, Ralf (2012): Quality attributes of recombinant therapeutic proteins: an assessment of impact on safety and efficacy as part of a quality by design development approach. In *Biotechnology progress* 28 (3), pp. 608-622. DOI: 10.1002/btpr.1548.

Feige, Matthias J.; Hendershot, Linda M.; Buchner, Johannes (2010): How antibodies fold. In *Trends in Biochemical Sciences* 35 (4), pp. 189-198. DOI: 10.1016/j.tibs.2009.11.005.

Ferrara, C.; Grau, S.; Jager, C.; Sondermann, P.; Brunker, P.; Waldhauer, I. et al. (2011): Unique carbohydrate-carbohydrate interactions are required for high affinity binding between Fc RIll and antibodies lacking core fucose. In *Proceedings of the National Academy of Sciences* 108 (31), pp. 12669-12674. DOI: 10.1073/pnas.1108455108.

Fukuda, M. N.; Sasaki, H.; Lopez, L.; Fukuda, M. (1989): Survival of recombinant erythropoietin in the circulation: the role of carbohydrates. In *Blood* 73 (1), pp. 84-89.

Geisler, Christoph; Jarvis, Donald L. (2012): Innovative use of a bacterial enzyme involved in sialic acid degradation to initiate sialic acid biosynthesis in glycoengineered insect cells. In *Metabolic Engineering* 14 (6), pp. 642-652. DOI: 10.1016/j.ymben.2012.08.005.

Geisler, Christoph; Mabashi-Asazuma, Hideaki; Jarvis, Donald L. (2015a): An Overview and History of Glyco-Engineering in Insect Expression Systems 1321, pp. 131-152. DOI: 10.1007/978-1-4939-2760-9_10.

Geisler, Christoph; Mabashi-Asazuma, Hideaki; Kuo, Chu-Wei; Khoo, Kay-Hooi; Jarvis, Donald L. (2015b): Engineering β1,4-galactosyltransferase I to reduce secretion and enhance N-glycan elongation in insect cells. In *J Biotechnol* 193, pp. 52-65. DOI: 10.1016/j.jbiotec.2014.11.013.

Hamilton, Stephen R.; Davidson, Robert C.; Sethuraman, Natarajan; Nett, Juergen H.; Jiang, Youwei; Rios, Sandra et al. (2006): Humanization of yeast to produce complex terminally sialylated glycoproteins. In *Science* 313 (5792), pp. 1441-1443. DOI: 10.1126/science.1130256.

Jacobs, P. P.; Geysens, S.; Vervecken, W.; Contreras, R.; Callewaert, N. (2009): Engineering complex-type N-glycosylation in *Pichia pastoris* using GlycoSwitch technology. In *Nature protocols* 4 (1), pp. 58-70.

Jefferis, Royston (2009): Recombinant antibody therapeutics: the impact of glycosylation on mechanisms of action. In *Trends in pharmacological sciences* 30 (7), pp. 356-362. DOI: 10.1016/j.tips.2009.04.007.

Jennewein, Madeleine F.; Alter, Galit (2017): The Immunoregulatory Roles of Antibody Glycosylation. In *Trends in Immunology* 38 (5), pp. 358-372. DOI: 10.1016/j.it.2017.02.004.

Ji, Wenyan; Sun, Wujin; Feng, Jinmei; Song, Tianshun; Zhang, Dalu; Ouyang, Pingkai et al. (2015): Characterization of a novel N-acetylneuraminic acid lyase favoring N-acetylneuraminic acid synthesis. In *Scientific reports* 5, p. 9341. DOI: 10.1038/srep09341.

Kellokumpu, Sakari; Hassinen, Antti; Glumoff, Tuomo (2016): Glycosyltransferase complexes in eukaryotes: long-known, prevalent but still unrecognized. In *Cell. Mol. Life Sci.* 73 (2), pp. 305-325. DOI: 10.1007/s00018-015-2066-0.

Klatt, Stephan; Konthur, Zoltan (2012): Secretory signal peptide modification for optimized antibody-fragment expression-secretion in *Leishmania tarentolae*. In *Microb Cell Fact* 11 (1), p. 97. DOI: 10.1186/1475-2859-11-97.

Kontermann, Roland E. (2016): Half-life extended biotherapeutics. In *Expert Opin Biol Ther* 16 (7), pp. 903-915. DOI: 10.1517/14712598.2016.1165661.

Krapp, S.; Mimura, Y.; Jefferis, R.; Huber, R.; Sondermann, P. (2003): Structural Analysis of Human IgG-Fc Glycoforms Reveals a Correlation Between Glycosylation and Structural Integrity. In *J Mol Biol* 325 (5), pp. 979-989. DOI: 10.1016/50022-2836(02)01250-0.

La Flamme, A C; Buckner, F. S.; Swindle, J.; Ajioka, J.; Van Voorhis, W C (1995): Expression of mammalian cytokines by *Trypanosoma cruzi* indicates unique signal sequence requirements and processing. In *Molecular and Biochemical Parasitology* 75 (1), pp. 25-31.

Lagassé, H A Daniel; Alexaki, Aikaterini; Simhadri, Vijaya L.; Katagiri, Nobuko H.; Jankowski, Wojciech; Sauna, Zuben E.; Kimchi-Sarfaty, Chava (2017): Recent advances in (therapeutic protein) drug development. In *F1000Res* 6, p. 113. DOI: 10.12688/f1000research.9970.1.

Li, Tiezheng; DiLillo, David J.; Bournazos, Stylianos; Giddens, John P.; Ravetch, Jeffrey V.; Wang, Lai-Xi (2017): Modulating IgG effector function by Fc glycan engineering. In *Proc Natl Acad Sci USA* 114 (13), pp. 3485-3490. DOI: 10.1073/pnas.1702173114.

Liu, Liming (2015): Antibody Glycosylation and Its Impact on the Pharmacokinetics and Pharmacodynamics of Monoclonal Antibodies and Fc-Fusion Proteins. In *J. Pharm. Sci.* 104 (6), pp. 1866-1884. DOI: 10.1002/jps.24444.

Liu, Liming (2017): Pharmacokinetics of monoclonal antibodies and Fc-fusion proteins. In *Protein & cell.* DOI: 10.1007/s13238-017-0408-4.

Luley-Goedl, Christiane; Schmoelzer, Katharina; Thomann, Marco; Malik, Sebastian; Greif, Michael; Ribitsch, Doris et al. (2016): Two N-terminally truncated variants of human β-galactoside α2,6 sialyltransferase I with distinct properties for in vitro protein glycosylation. In *Glycobiology* 26 (10), pp. 1097-1106. DOI: 10.1093/glycob/cww046.

McConville, Malcolm J.; Ilgoutz, Steven C.; Teasdale, Rohan D.; Foth, Bernardo J.; Matthews, Antony; Mullin, Kylie A.; Gleeson, Paul A. (2002a): Targeting of the GRIP domain to the trans-Golgi network is conserved from protists to animals. In *European journal of cell biology* 81 (9), pp. 485-495. DOI: 10.1078/0171-9335-00268.

McConville, Malcolm J.; Mullin, Kylie A.; Ilgoutz, Steven C.; Teasdale, Rohan D. (2002b): Secretory pathway of trypanosomatid parasites. In *Microbiol Mol Biol Rev* 66 (1), 122-54; table of contents.

Merry, A. H.; Neville, D. C.; Royle, L.; Matthews, B.; Harvey, D. J.; Dwek, R. A.; Rudd, P. M. (2002): Recovery of intact 2-aminobenzamide-labeled O-glycans released from glycoproteins by hydrazinolysis. In *Anal Biochem* 304 (1), pp. 91-99. DOI: 10.1006/abio.2002.5620.

Millward, Thomas A.; Heitzmann, Markus; Bill, Kurt; Langle, Ulrich; Schumacher, Peter; Forrer, Kurt (2008): Effect of constant and variable domain glycosylation on pharmacokinetics of therapeutic antibodies in mice. In *Biologicals* 36 (1), pp. 41-47. DOI: 10.1016/j.biologicals.2007.05.003.

Moremen, Kelley W.; Tiemeyer, Michael; Nairn, Alison V. (2012): Vertebrate protein glycosylation: diversity, synthesis and function. In *Nat Rev Mol Cell Biol* 13 (7), pp. 448-462. DOI: 10.1038/nrm3383.

Raymond, Frédéric; Boisvert, Sébastien; Roy, Gaétan; Ritt, Jean-François; Légaré, Danielle; Isnard, Amandine et al. (2012): Genome sequencing of the lizard parasite *Leishmania tarentolae* reveals loss of genes associated to the intracellular stage of human pathogenic species. In *Nucleic Acids Res* 40 (3), pp. 1131-1147. DOI: 10.1093/nar/gkr834.

Reusch, Dietmar; Tejada, Max L. (2015): Fc glycans of therapeutic antibodies as critical quality attributes. In *Glycobiology* 25 (12), pp. 1325-1334. DOI: 10.1093/glycob/cwv065.

Roper, Janine R.; Ferguson, Michael A. J. (2003): Cloning and characterisation of the UDP-glucose 4'-epimerase of *Trypanosoma cruzi*. In *Molecular and Biochemical Parasitology* 132 (1), pp. 47-53. DOI: 10.1016/j.molbiopara.2003.07.002.

Roper, Janine R.; Guther, Maria Lucia S; Milne, Kenneth G.; Ferguson, Michael A J (2002): Galactose metabolism is essential for the African sleeping sickness parasite *Trypanosoma brucei*. In *Proc Natl Acad Sci USA* 99 (9), pp. 5884-5889. DOI: 10.1073/pnas.092669999.

Royle, L.; Mattu, T. S.; Hart, E.; Langridge, J. I.; Merry, A. H.; Murphy, N. et al. (2002): An analytical and structural database provides a strategy for sequencing O-glycans from microgram quantities of glycoproteins. In *Anal Biochem* 304 (1), pp. 70-90. DOI: 10.1006/abio.2002.5619.

Sansom, Fiona M.; Ralton, Julie E.; Sernee, M. Fleur; Cohen, Alice M.; Hooker, David J.; Hartland, Elizabeth L. et al. (2014): Golgi-located NTPDase1 of *Leishmania major* is required for lipophosphoglycan elongation and normal lesion development whereas secreted NTPDase2 is dispensable for virulence. In *PLoS neglected tropical diseases* 8 (12), e3402. DOI: 10.1371/journal.pntd.0003402.

Schauer, R. (2000): Achievements and challenges of sialic acid research. In *Glycoconj J* 17 (7-9), pp. 485-499.

Son, Young-Dok; Jeong, Yeon Tae; Park, Seung-Yeol; Kim, Jung Hoe (2011): Enhanced sialylation of recombinant human erythropoietin in Chinese hamster ovary cells by combinatorial engineering of selected genes. In *Glycobiology* 21 (8), pp. 1019-1028. DOI: 10.1093/glycob/cwr034.

Sondermann, P.; Pincetic, A.; Maamary, J.; Lammens, K.; Ravetch, J. V. (2013): General mechanism for modulating immunoglobulin effector function 110 (24), pp. 9868-9872. DOI: 10.1073/pnas.1307864110.

Stanley, P. (2011): Golgi Glycosylation. In *Cold Spring Harbor Perspectives in Biology* 3 (4), a005199. DOI: 10.1101/cshperspect.a005199.

Strasser, Richard (2016): Plant protein glycosylation. In *Glycobiology*, cww023. DOI: 10.1093/glycob/cww023.

Sun, Liangwu; Eklund, Erik A.; Chung, Wendy K.; Wang, Chao; Cohen, Jason; Freeze, Hudson H. (2005): Congenital disorder of glycosylation id presenting with hyperinsulinemic hypoglycemia and islet cell hyperplasia. In *J Clin Endocrinol Metab* 90 (7), pp. 4371-4375. DOI: 10.1210/jc.2005-0250.

Tada, Minoru; Tatematsu, Ken-ichiro; Ishii-Watabe, Akiko; Harazono, Akira; Takakura, Daisuke; Hashii, Noritaka et al. (2015): Characterization of anti-CD20 monoclonal antibody produced by transgenic silkworms (*Bombyx mori*). In *mAbs* 7 (6), pp. 1138-1150. DOI: 10.1080/19420862.2015.1078054.

Urbaniak, M. D.; Turnock, D. C.; Ferguson, M. A. J. (2006): Galactose Starvation in a Bloodstream Form *Trypanosoma brucei* UDP-Glucose 4'-Epimerase Conditional Null Mutant. In *Eukaryotic Cell* 5 (11), pp. 1906-1913. DOI: 10.1128/EC.00156-06.

Varki, Ajit (2009): Essentials of glycobiology. 2. ed. Cold Spring Harbor, N.Y.: Cold Spring Harbor Laboratory Press.

Varki, Ajit (2017): Biological roles of glycans. In *Glycobiology* 27 (1), pp. 3-49. DOI: 10.1093/glycob/cww086.

Vimr, Eric R.; Kalivoda, Kathryn A.; Deszo, Eric L.; Steenbergen, Susan M. (2004): Diversity of microbial sialic acid metabolism. In *Microbiol Mol Biol Rev* 68 (1), pp. 132-153.

---

SEQUENCE LISTING (157 sequences)

SEQ ID NO: 1 - DNA, 7992 bp, Artificial Sequence
  pLMTB3904(ssu::rhEPO-8His; sat marker (nourseothricin resistance))
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctgccatggcctcgaggctcgtccgtgtgctggccgccgccatgctggttgcagcggccgtgtcggtcgacgcggcgccgccacgcctgatctgcgacagccgcgtgctggagcgctacctgctggaggcgaaggaagcggagaacatcaccaccggctgcgcggagcactgcagcctgaacgagaacatcacggtgccggacacgaaggtgaacttctacgcgtggaagcgcatggaggtcggccagcaggcggtggaggtctggcagggcctggcgctgctgagcgaggcggtgctgcgcggccaggccctgctggtgaacagcagccagccgtgggagccgctgcagctgcacgtggacaaggccgtgagcggcctgcgcagcctgaccaccctgctgcgcgccctgggcgcccagaaggaagcgatcagcccgccggacgccgccagcgccgccccgctgcgcacgatcacggccgacacgttccgcaagctgttccgcgtgtacagcaacttcctgcgcggcaagctgaagctgtacaccggcgaggcctgccgcaccggcgaccaccatcatcaccaccaccaccactaatctagccttaagggtacccaccaccatcaccaccactaggcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatcctagtatgaagatttcggtgatccctgagcaggtggcggaaacattggatgctgagaaccatttcattgttcgtgaagtgttcgatgtgcacctatccgaccaaggctttgaactatctaccagaagtgtgagcccctaccggaaggattacatctcggatgatgactctgatgaagactctgcttgctatggcgcattcatcgaccaagagcttgtcgggaagattgaactcaactcaacatggaacgatctagcctctatcgaacacattgttgtgtcgcacacgcaccgaggcaaaggagtcgcgcacagtctcatcgaatttgcgaaaaagtgggcactaagcagacagctccttggcatacgattagagacacaaacgaacaatgtacctgcctgcaatttgtacgcaaaatgtggctttactctcggcggcattgacctgttcacgtataaaactagacctcaagtctcgaacgaaacagcgatgtactggtactggttctcgggagcacaggatgacgcctaactagcctcggagatccactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 2 - DNA, 9112 bp, Artificial Sequence
  pLMTB4101 (ssu::TbGnTI 3xHA; hyg marker (hygromycin resistance))
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctaagcttatggcaatcaaatcacgaggagttaaagttgtaattatagtttttattgccgtgtatgtgttgacaattacaaatgttctcattagtttgcatcgtttccaccaaaattcccaaaaggaggtggttaaaattcaacgagatgaaccattgccagattttgagtacaccgaagatgacaaaatggcgttggaatttgtaacaccgcatattataaagaaatggcggaatcataattatctcgtagcactcggtattccttcaccagataatgaagagcgacggcggcggcgacaacttcaacgggacacatgttggaaatatccgggagttgccaccgtagaaaataattttgaaggagatatgctcgtagcatatgtattggctcgtcatccacaatttgattacaaatattcacctgaattgaaggatgaagcaaataaatggcgggatgtcattacgctccccataaatgaaggtcgtgtcacaactaaaaagaaattgggagaagttgcgcattggggaattgatgcggaaattggtatgagtcgaaaaatatatttgtggtttgaattgggagcgcgccttcttccgaaaacaagttatttctctaaaggtgatgatgacgcgtttttccattcaccgcagtacattattgatttgcgaactttgccgcgtcgtggtgtttattgggcatttcattggcgtataaatccagtgaggccttttatatttggccgtggcctcttgtacaccatgtcgcgagatgttgttaataaatttgtaacatatgaaccggtacgccgccttgtgcatgtgccattcagttttgatcggcttcttgaatttaagcaatccattatggaatatgaagatgccatggtcggtcatgcactttcttatcaaaatccagaagaattgttgtttgtgaatgaaagttgctgccgcttcatcatattgaatggtaatgagtgcaagccaccgaaaaataacaattttgtagtagttcatggtattcaagaagaagaatacgcaataatgatggaacgctttaaaaattacacaactcccgttcctgttcaatttattccctcaaaatatggttggatggccaattgcacattgccaccagatccacaacggcggcgggatgcggaatggacggcagcgggagcgtatccttatgacgtccctgattacgcatatccttatgacgtccctgattacgcatatccttatgacgtccctgattacgcataatctagagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 3 - DNA, 9112 bp, Artificial Sequence
  pLMTB4111 (ssu::TbGnTI 3xHA; hyg marker (hygromycin resistance))
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctaagcttatggccatcaaaagccgcggcgtgaaggtcgtgatcatcgtcttcatcgcggtctacgtgctgaccatcacgaacgtgctgatcagcctgcaccgcttccaccagaacagccagaaggaggtggtgaagatccagcgcgacgagccgctgcccgactttgagtacacggaggacgacaagatggcgctcgagttcgtcaccccgcacatcattaagaagtggcggaaccacaactacctcgtggcgctgggcattccgagccccgacaatgaggagcgccgccggcgccgccagctgcagcgcgacacgtgctggaagtaccccggcgtggcgacggtggagaacaatttcgagggcgacatgctggtggcctacgtgctggcgcgccacccgcagttcgactacaagtacagcccggagctcaaggacgaggcgaacaagtggcgcgacgtgatcaccctgccgatcaacgagggccgcgtgacgacgaagaaaaagctgggcgaggtggcgcactggggtatcgacgcggagatcggcatgagccgcaaaatctacctctggtttgagctgggtgcccggctgctgccgaagacgtcgtacttcagcaagggcgacgacgacgcgttcttccactcgccgcagtacattatcgacctccgcacgctgccccgccgcggcgtgtactgggcgttccactggcgcatcaatccggtccgccccttcatctttggtcgcggcctgctgtacacgatgagccgcgatgtggtgaacaagtttgtgacgtacgagccggtccgccgcctcgtgcacgtcccgtttagcttcgaccggctcctggagttcaagcagagcatcatggaatatgaggacgcgatggtgggccacgcgctgagctaccagaacccggaggagctgctgttcgtcaacgagtcgtgctgccgcttcatcattctcaacggcaacgaatgcaagccgccgaaaaataacaactttgtcgtggtgcacggcatccaggaggaggaatacgccatcatgatggagcggttcaagaactacacgacgccggtgccggtgcaatttatcccgtcgaagtacggctggatggcgaactgcacgctcccgccggatccgcagcgccgccgcgacgcggaatggacggcggccggcgcgtatccgtacgatgtcccggattacgcctacccctacgacgtgccggactacgcctacccgtacgacgtcccggactatgcctgatctagagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 4 - DNA, 9067 bp, Artificial Sequence
  pLMTB4117 (ssu::TbGnTII 3xHA; hyg marker (hygromycin resistance))
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctaagcttatggtgtggagcggccataagtacaaacgcctgctcccgctgtgcctgctgaccctgctgtggttcctctcgctctcgcgcttccgccgcgtcgaggtgccgaagcaacgcgagaacatccagcacagcttcgagccgaccctgacgacgctgaacgaggaggacctgcaatcggtgcagttcattccgcaggcgacggtggacgtgctgcgccggcgggacttttttgtggccgtgggcttcctgagcccggacaataacgagcgccgccggcgccgctatctgctgcgcctcacgagcttccagtatccgggcgtggccacgaagtcgaacaacttctcgggcgaactgatgatcgcctttatcctggcgcggcaccccgaccacaactacaccttcagcgcgaagctgaaggaggaggcgtggcactggaacgacatcatctcgctcccgatggacgagggtaaggtcagcaccaacaagacgacgggcgatggtacgcattggggcccggccacggagatcggcatgagccggaaggtgttccactggtacgacttcgcgctgcggttcttccgcaacgtgacgtacatcagcaaggccgacgacgatgcgttcctccacgtgccgcagttcctcgcggatctgcacacgctgccgcgccggcgcgtgtactggggctacatgaagcccatgacggtgaaggacccgttctacttcgccgcgggcatcctgtacacgctgtcgcgcgacgtgtcggaggcgtttgtggcgtacgagccgctccgcaagatcattcgcgtgccctattcgaaggagcgcgagatggagttcaagcccctgatcctggagaacgaagacatcatggtcgcgcgcgtgatctcgtacctgcgcctggacaacctccggtactacgtggagagctgctgtcgcttcaacgacctgaactacggcttctgcagcggcgtgcgcgacaccagcgtcatcatccacggcgtcaaggagggccaatacgcggacatcgtgaaccgcctgggcaaacaccgcaccgtggcgaatccgttctaccgcggctacctcggttggcacgcgagctgcaccgccggcgcgtatccgtacccgtacgatgtgccggattacgcctacccgtatccgtacgacgtgcccgactacgcctatccgtacccctatgacgtgccggactacgcgtgatctagagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 5 - DNA, 9217 bp, Artificial Sequence
  pLMTB4123 (ssu::SfGnT-I Strep; hyg marker (hygromycin resistance))
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctaagcttatgcggctcaacgtcaagaaggcgctcatcttcgtcggctgcgtggtcttcctctgggtcctgctctcgtacgcgagcgtgattgaggtgccgcgcgcggtcccgcagaaggacccggccgtggagatcgagaagaaaatcattaagctgcaaaagcaggtggacgcccagatggccgagagcaaatcgctgctggcgaaggtcaagaagctgaagaagattagcgagggcgagaacgtgggtggcgaagaggacagcctgaaggactcggaggtgatgcagcacctgtcgcagccgatcctgccggtcctcgtcatcgcgtgtgaccgggtgaccgtccagcgctgcctggacaacctcgtcaagttccgccccagcaaggagacgttcccgatcattgtgagccaagactgtggccacaacgccacctacgaagtgatcacgagctacacggcgagcgacccgacgatcagcgtggtgcgccaaccggacctcagcgagatcgtgctgccccgcgtgaaggtgaagttccggggctactacaagatcgcccgccactataagttcgcgctgaaccacgtctttgagacgctgggccatgaagcggtgatcattgtggaggatgacctggacatctcgccggacttcttcgagtactttctcggcacgtacccgctgctgctgaaggatccgagcctgtggtgcatctcggcgtggaacgacaacggcaagatggaggtcattgatatgtcgcgccccgacctcctccatcgcacggacttcttcccgggcctcggttgggtcctccggcgcgaaatgtggcgcaagctggcgccgaagtggcccacggccttcttcgacgactggctgcgcaacccggtgaatatcgacggcaaggcctgcatccgcccggagatcagccgcacgtacagcttcggcaaggtcggcgtgagcaagggcctgttctttgacctccatctgcgcaacatccagctcaacatggagtacgtggagttcacgaagctgaacctgacgtacctcctgaaggagcactacgacgacgcgctggtgagcacggtgtacaacctgccggaaatgtcggcgagcgaggtggtggcgggcagcgacctgagcgccgacccggtgcgcgtcatgtactcgaacgcgaagacctaccagcgcgccgccaagaagctcggcctgatggacgatttccgctcgggcgtgccgcgcacggcgtatcgcggcattgtgacgtgctttatccggggccgccgcgtgtatctcgccccgagcttcgagtggaacaagtacgatcccacgtggggtgcgggcgcctggagccatccgcagttcgagtgatctagagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 6 - DNA, 9262 bp, Artificial Sequence
  pLMTB4575 (ssu::rMGAT2 3xHA; hyg marker (hygromycin resistance))
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctatgcggttccggatctataagcggaaggtcctgatcctgaccctggtcgtcgccgcctgcggcttcgtcctgtggtcctccaacggccggcagcggaagaacgacgccctggccccccccctgctggactccgagcccctgcggggcgccggccacttcgccgcctccgtcggcatccggcgggtctccaacgactccgccgcccccctggtccccgccgtcccccggcccgaggtcgacaacctgaccctgcggtatcggtccctggtctatcagctgaacttcgaccagatgctgcggaacgtcgacaaggacggcacctggtcccccggcgagctggtcctggtcgtccaggtccacaaccggcccgagtatctgcggctgctgatcgactccctgcggaaggcccagggcatccgggaggtcctggtcatcttctcccacgacttctggtccgccgagatcaactccctgatctcctccgtcgacttctgccccgtcctgcaggtcttcttccccttctccatccagctgtatccctccgagttccccggctccgacccccgggactgcccccgggacctgaagaagaacgccgccctgaagctgggctgcatcaacgccgagtatcccgactccttcggccactatcgggaggccaagttctcccagaccaagcaccactggtggtggaagctgcacttcgtctgggagcgggtcaaggtcctgcaggactataccggcctgatcctgttcctggaggaggaccactatctggcccccgacttctatcacgtcttcaagaagatgtggaagctgaagcagcaggagtgccccggctgcgacgtcctgtccctgggcacctataccaccatccggtccttctatggcatcgccgacaaggtcgacgtcaagacctggaagtccaccgagcacaacatgggcctggccctgacccgggacgcctatcagaagctgatcgagtgcaccgacaccttctgcacctatgacgactataactgggactggaccctgcagtatctgaccctggcctgcctgcccaaggtctggaaggtcctggtcccccaggccccccggatcttccacgccggcgactgcggcatgcaccacaagaagacctgccggccctccacccagtccgcccagatcgagtccctgctgaacaacaacaagcagtatctgttccccgagaccctggtcatcggcgagaagttccccatggccgccatctcccccccccggaagaacggcggctggggcgacatccgggaccacgagctgtgcaagtcctatcggcggctgcaggcgggagcgtatccttatgacgtccctgattacgcatatccttatgacgtccctgattacgcatatccttatgacgtccctgattacgcataagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 7 - DNA, 9208 bp, Artificial Sequence
  pLMTB4577 (ssu::SfGnT-I Strep; hyg marker (hygromycin resistance))
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctatgcggctgaacgtcaagaaggccctgatcttcgtcggctgcgtcgtcttcctgtgggtcctgctgtcctatgcctccgtcatcgaggtcccccgggccgtcccccagaaggaccccgccgtcgagatcgagaagaagatcatcaagctgcagaagcaggtcgacgcccagatggccgagtccaagtccctgctggccaaggtcaagaagctgaagaaaatttctgagggcgagaacgtcggcggcgaggaggactccctgaaggactccgaggtcatgcagcacctgtcccagcccatcctgcccgtcctggtcatcgcctgcgaccgggtcaccgtccagcggtgcctggacaacctggtcaagttccggccctccaaggagaccttccccatcatcgtctcccaggactgcggccacaacgccacctatgaggtcatcacctcctataccgcctccgaccccaccatctccgtcgtccggcagcccgacctgtccgagatcgtcctgccccgggtcaaggtcaagttccggggctattataagatcgcccggcactataagttcgccctgaaccacgtcttcgagaccctgggccacgaggccgtcatcatcgtcgaggacgacctggacatctcccccgacttcttcgagtatttcctgggcacctatcccctgctgctgaaggacccctccctgtggtgcatctccgcctggaacgacaacggcaagatggaggtcatcgacatgtcccggcccgacctgctgcaccggaccgacttcttccccggcctgggctgggtcctgcggcgggagatgtggcggaagctggcccccaagtggcccaccgccttcttcgacgactggctgcggaaccccgtcaacatcgacggcaaggcctgcatccggcccgaaatttctcggacctattccttcggcaaggtcggcgtctccaagggcctgttcttcgacctgcacctgcggaacatccagctgaacatggagtatgtcgagttcaccaagctgaacctgacctatctgctgaaggagcactatgacgacgccctggtctccaccgtctataacctgcccgagatgtccgcctccgaggtcgtcgccggctccgacctgtccgccgaccccgtccgggtcatgtattccaacgccaagacctatcagcgggccgccaagaagctgggcctgatggacgacttccggtccggcgtcccccggaccgcctatcggggcatcgtcacctgcttcatccggggccggcgggtctatctggccccctccttcgagtggaacaagtatgaccccacctggggcgcgggcgcctggtcccacccgcagttcgagaagtaagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 8 - DNA, 9049 bp, Artificial Sequence
  pLMTB4578 (ssu::CTS of Man1-SfGnT-I Strep; hyg marker (hygromycin resistance))
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctatgcagcggcagcggatccggcaccacctgcggttcgtcgaccggtatatcgtcctggccgtcctgggcgtcgtcgtctatatcctggtcgtctccctgatcgccgagtccctggccatcggcgtccgggaccggcccatcctgcccgtcctggtcatcgcctgcgaccgggtcaccgtccagcggtgcctggacaacctggtcaagttccggccctccaaggagaccttccccatcatcgtctcccaggactgcggccacaacgccacctatgaggtcatcacctcctataccgcctccgaccccaccatctccgtcgtccggcagcccgacctgtccgagatcgtcctgccccgggtcaaggtcaagttccggggctattataagatcgcccggcactataagttcgccctgaaccacgtcttcgagaccctgggccacgaggccgtcatcatcgtcgaggacgacctggacatctcccccgacttcttcgagtatttcctgggcacctatcccctgctgctgaaggacccctccctgtggtgcatctccgcctggaacgacaacggcaagatggaggtcatcgacatgtcccggcccgacctgctgcaccggaccgacttcttccccggcctgggctgggtcctgcggcgggagatgtggcggaagctggcccccaagtggcccaccgccttcttcgacgactggctgcggaaccccgtcaacatcgacggcaaggcctgcatccggcccgaaatttctcggacctattccttcggcaaggtcggcgtctccaagggcctgttcttcgacctgcacctgcggaacatccagctgaacatggagtatgtcgagttcaccaagctgaacctgacctatctgctgaaggagcactatgacgacgccctggtctccaccgtctataacctgcccgagatgtccgcctccgaggtcgtcgccggctccgacctgtccgccgaccccgtccgggtcatgtattccaacgccaagacctatcagcgggccgccaagaagctgggcctgatggacgacttccggtccggcgtcccccggaccgcctatcggggcatcgtcacctgcttcatccggggccggcgggtctatctggccccctccttcgagtggaacaagtatgaccccacctggggcgcgggcgcctggtcccacccgcagttcgagaagtaagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 9 - DNA, 9055 bp, Artificial Sequence
  pLMTB4579 (ssu::CTS of LtaNTPDase1-SfGnT-I Strep; hyg marker (hygromycin resistance))
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctatgcggcccaacctgtccgtccggcggatgacccaccagtggaagcggctgcgggtcaccggcaccctggtcctgtccgccctggtcctgttcgccttcgtcgtctattatcagtccccctccttctccccctgcgactcccccatcctgcccgtcctggtcatcgcctgcgaccgggtcaccgtccagcggtgcctggacaacctggtcaagttccggccctccaaggagaccttccccatcatcgtctcccaggactgcggccacaacgccacctatgaggtcatcacctcctataccgcctccgaccccaccatctccgtcgtccggcagcccgacctgtccgagatcgtcctgccccgggtcaaggtcaagttccggggctattataagatcgcccggcactataagttcgccctgaaccacgtcttcgagaccctgggccacgaggccgtcatcatcgtcgaggacgacctggacatctcccccgacttcttcgagtatttcctgggcacctatcccctgctgctgaaggacccctccctgtggtgcatctccgcctggaacgacaacggcaagatggaggtcatcgacatgtcccggcccgacctgctgcaccggaccgacttcttccccggcctgggctgggtcctgcggcgggagatgtggcggaagctggcccccaagtggcccaccgccttcttcgacgactggctgcggaaccccgtcaacatcgacggcaaggcctgcatccggcccgaaatttctcggacctattccttcggcaaggtcggcgtctccaagggcctgttcttcgacctgcacctgcggaacatccagctgaacatggagtatgtcgagttcaccaagctgaacctgacctatctgctgaaggagcactatgacgacgccctggtctccaccgtctataacctgcccgagatgtccgcctccgaggtcgtcgccggctccgacctgtccgccgaccccgtccgggtcatgtattccaacgccaagacctatcagcgggccgccaagaagctgggcctgatggacgacttccggtccggcgtcccccggaccgcctatcggggcatcgtcacctgcttcatccggggccggcgggtctatctggccccctccttcgagtggaacaagtatgaccccacctggggcgcgggcgcctggtcccacccgcagttcgagaagtaagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 10 - DNA, 9370 bp, Artificial Sequence
  pLMTB4695 (ssu::SfGnT-II Strep; hyg marker (hygromycin resistance))
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctatgccgcgcctgaagtacgcgagcgtggcgcgcgtggtggtgatcctgggcctgttctgcctgtggctgcagatcatgctgagcgcgagcacgggcggcatgtaccgcgacggcgaggagctgatgaacgcgaacgacacgagcgagcaggtgctggcgctggtgccgccggagctgcacaagtacctgacggtgcacccgcgcaacaacagcggcaacacgacggaccgcatcgcggtgaagaacatcacggagatcaagcaggcgatcaagcgctacaacgacgcgcagacgatctacaacgaggacatcttcggcgcggtgcagaacgacacggtgatcatcgcgatccaggtgcacacgcgcctgacgtacctgcgccacctgatcgtgagcctggcgcaggcgaaggagatcgaccgcacgctgctgatcttcagccacgactactacgacgaggagatcaacaacctggtgcgcagcatcgacttcacgaaggtgatgcaaattttttacccgtacagcatccagacgcacccgcacgagttcccgggcatggaccacaacgactgcccgcgcgacacgaagttcgagcaggcggtgaagctggagtgcaacaacgcgctgtacccggacctgcacggccactaccgcgaggcgaagtacacgcagacgaagcaccactggtggtggaaggcgaaccgcatcttcaaccagctgcagtgcacggcgggccacacgggctacgtgctgttcctggaggaggaccactacgtggcggaggacttcctgcacatcctgaacctgctgaagagcacggcggacaagagctgcccgcagtgcgagatgctgagcctgggcacgtacctgaagacgtaccagtaccacgtgaacggcgacaagcgcaagaagaacatgaacctgaactacatccagcaggtgaagctggcgaacgaggagcgccgcaagaagcacgagaacaacccgacgtggaacttccaggtgtacccgcacctgtacacggcgacgcagaaggtggagatcacgccgtggcacagcagcatgcacaacatgggcttcgcgttcaaccgcacggtgtggaaccacatcatgaagcagcagagccagttctgcgcgtacgacgactacaactgggactacagcctgctgcacctgagccagaacatgccgggccgcgagaagttcaaggtgatcgtgtgcaagggcccgcgcgtgttccacatcggcgagtgcggcttccaccacaagaagagcaactgcaacgcgagcacggtgatcagcaaggtgcagaagctgctgcagaacgcgaagccgtacctgtacccgacgcgcgtgagcgcgcaggtgacggcgggcggcgcgaagcacaacaagaagctggtgaagggcaacggcggctggggcgacatccgcgaccaggagctgtgcacgaacatgacgaaggtgggccgccagcaccgccacacgatcttctacgcgtggtcccacccgcagttcgagaagtaagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 11 - DNA, 8724 bp, Artificial Sequence
  pLMTB4696 (ssu::SfGnT-II Strep; ble marker (zeocin resistance))
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctatgccgcgcctgaagtacgcgagcgtggcgcgcgtggtggtgatcctgggcctgttctgcctgtggctgcagatcatgctgagcgcgagcacgggcggcatgtaccgcgacggcgaggagctgatgaacgcgaacgacacgagcgagcaggtgctggcgctggtgccgccggagctgcacaagtacctgacggtgcacccgcgcaacaacagcggcaacacgacggaccgcatcgcggtgaagaacatcacggagatcaagcaggcgatcaagcgctacaacgacgcgcagacgatctacaacgaggacatcttcggcgcggtgcagaacgacacggtgatcatcgcgatccaggtgcacacgcgcctgacgtacctgcgccacctgatcgtgagcctggcgcaggcgaaggagatcgaccgcacgctgctgatcttcagccacgactactacgacgaggagatcaacaacctggtgcgcagcatcgacttcacgaaggtgatgcaaattttttacccgtacagcatccagacgcacccgcacgagttcccgggcatggaccacaacgactgcccgcgcgacacgaagttcgagcaggcggtgaagctggagtgcaacaacgcgctgtacccggacctgcacggccactaccgcgaggcgaagtacacgcagacgaagcaccactggtggtggaaggcgaaccgcatcttcaaccagctgcagtgcacggcgggccacacgggctacgtgctgttcctggaggaggaccactacgtggcggaggacttcctgcacatcctgaacctgctgaagagcacggcggacaagagctgcccgcagtgcgagatgctgagcctgggcacgtacctgaagacgtaccagtaccacgtgaacggcgacaagcgcaagaagaacatgaacctgaactacatccagcaggtgaagctggcgaacgaggagcgccgcaagaagcacgagaacaacccgacgtggaacttccaggtgtacccgcacctgtacacggcgacgcagaaggtggagatcacgccgtggcacagcagcatgcacaacatgggcttcgcgttcaaccgcacggtgtggaaccacatcatgaagcagcagagccagttctgcgcgtacgacgactacaactgggactacagcctgctgcacctgagccagaacatgccgggccgcgagaagttcaaggtgatcgtgtgcaagggcccgcgcgtgttccacatcggcgagtgcggcttccaccacaagaagagcaactgcaacgcgagcacggtgatcagcaaggtgcagaagctgctgcagaacgcgaagccgtacctgtacccgacgcgcgtgagcgcgcaggtgacggcgggcggcgcgaagcacaacaagaagctggtgaagggcaacggcggctggggcgacatccgcgaccaggagctgtgcacgaacatgacgaaggtgggccgccagcaccgccacacgatcttctacgcgtggtcccacccgcagttcgagaagtaagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccgcatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgaccgactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 12 - DNA, 9373 bp, Artificial Sequence
  pLMTB4697 (ssu::CTS of TbGnTI-SfGnT-II Strep hyg marker (hygromycin resistance))
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctatggcgatcaagagccgcggcgtgaaggtggtgatcatcgtgttcatcgcggtgtacgtgctgacgatcacgaacgtgctgatcagcctgcaccgcttccaccagaacagcgacggcgaggagctgatgaacgcgaacgacacgagcgagcaggtgctggcgctggtgccgccggagctgcacaagtacctgacggtgcacccgcgcaacaacagcggcaacacgacggaccgcatcgcggtgaagaacatcacggagatcaagcaggcgatcaagcgctacaacgacgcgcagacgatctacaacgaggacatcttcggcgcggtgcagaacgacacggtgatcatcgcgatccaggtgcacacgcgcctgacgtacctgcgccacctgatcgtgagcctggcgcaggcgaaggagatcgaccgcacgctgctgatcttcagccacgactactacgacgaggagatcaacaacctggtgcgcagcatcgacttcacgaaggtgatgcaaattttttacccgtacagcatccagacgcacccgcacgagttcccgggcatggaccacaacgactgcccgcgcgacacgaagttcgagcaggcggtgaagctggagtgcaacaacgcgctgtacccggacctgcacggccactaccgcgaggcgaagtacacgcagacgaagcaccactggtggtggaaggcgaaccgcatcttcaaccagctgcagtgcacggcgggccacacgggctacgtgctgttcctggaggaggaccactacgtggcggaggacttcctgcacatcctgaacctgctgaagagcacggcggacaagagctgcccgcagtgcgagatgctgagcctgggcacgtacctgaagacgtaccagtaccacgtgaacggcgacaagcgcaagaagaacatgaacctgaactacatccagcaggtgaagctggcgaacgaggagcgccgcaagaagcacgagaacaacccgacgtggaacttccaggtgtacccgcacctgtacacggcgacgcagaaggtggagatcacgccgtggcacagcagcatgcacaacatgggcttcgcgttcaaccgcacggtgtggaaccacatcatgaagcagcagagccagttctgcgcgtacgacgactacaactgggactacagcctgctgcacctgagccagaacatgccgggccgcgagaagttcaaggtgatcgtgtgcaagggcccgcgcgtgttccacatcggcgagtgcggcttccaccacaagaagagcaactgcaacgcgagcacggtgatcagcaaggtgcagaagctgctgcagaacgcgaagccgtacctgtacccgacgcgcgtgagcgcgcaggtgacggcgggcggcgcgaagcacaacaagaagctggtgaagggcaacggcggctggggcgacatccgcgaccaggagctgtgcacgaacatgacgaaggtgggccgccagcaccgccacacgatcttctacgcgtggtcccacccgcagttcgagaagtaagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 13 - DNA, 8790 bp, Artificial Sequence
  pLMTB4700 (ssu::SfGnT-II 3xHA; ble marker (zeocin resistance))
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctatgccgcgcctgaagtacgcgagcgtggcgcgcgtggtggtgatcctgggcctgttctgcctgtggctgcagatcatgctgagcgcgagcacgggcggcatgtaccgcgacggcgaggagctgatgaacgcgaacgacacgagcgagcaggtgctggcgctggtgccgccggagctgcacaagtacctgacggtgcacccgcgcaacaacagcggcaacacgacggaccgcatcgcggtgaagaacatcacggagatcaagcaggcgatcaagcgctacaacgacgcgcagacgatctacaacgaggacatcttcggcgcggtgcagaacgacacggtgatcatcgcgatccaggtgcacacgcgcctgacgtacctgcgccacctgatcgtgagcctggcgcaggcgaaggagatcgaccgcacgctgctgatcttcagccacgactactacgacgaggagatcaacaacctggtgcgcagcatcgacttcacgaaggtgatgcaaattttttacccgtacagcatccagacgcacccgcacgagttcccgggcatggaccacaacgactgcccgcgcgacacgaagttcgagcaggcggtgaagctggagtgcaacaacgcgctgtacccggacctgcacggccactaccgcgaggcgaagtacacgcagacgaagcaccactggtggtggaaggcgaaccgcatcttcaaccagctgcagtgcacggcgggccacacgggctacgtgctgttcctggaggaggaccactacgtggcggaggacttcctgcacatcctgaacctgctgaagagcacggcggacaagagctgcccgcagtgcgagatgctgagcctgggcacgtacctgaagacgtaccagtaccacgtgaacggcgacaagcgcaagaagaacatgaacctgaactacatccagcaggtgaagctggcgaacgaggagcgccgcaagaagcacgagaacaacccgacgtggaacttccaggtgtacccgcacctgtacacggcgacgcagaaggtggagatcacgccgtggcacagcagcatgcacaacatgggcttcgcgttcaaccgcacggtgtggaaccacatcatgaagcagcagagccagttctgcgcgtacgacgactacaactgggactacagcctgctgcacctgagccagaacatgccgggccgcgagaagttcaaggtgatcgtgtgcaagggcccgcgcgtgttccacatcggcgagtgcggcttccaccacaagaagagcaactgcaacgcgagcacggtgatcagcaaggtgcagaagctgctgcagaacgcgaagccgtacctgtacccgacgcgcgtgagcgcgcaggtgacggcgggcggcgcgaagcacaacaagaagctggtgaagggcaacggcggctggggcgacatccgcgaccaggagctgtgcacgaacatgacgaaggtgggccgccagcaccgccacacgatcttctacgcggcgggagcgtatccttatgacgtccctgattacgcatatccttatgacgtccctgattacgcatatccttatgacgtccctgattacgcataagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccgcatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgaccgactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 14 - DNA, 8418 bp, Artificial Sequence
  pLMTB4703 (ssu::B4GALT1 Strep; ble marker (zeocin resistance))
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctatgcgcctgcgcgagccgctgctgagcggcagcgcggcgatgccgggcgcgagcctgcagcgcgcgtgccgcctgctggtggcggtgtgcgcgctgcacctgggcgtgacgctggtgtactacctggcgggccgcgacctgagccgcctgccgcagctggtgggcgtgagcacgccgctgcagggcggcagcaacagcgcggcggcgatcggccagagcagcggcgagctgcgcacgggcggcgcgcgcccgccgccgccgctgggcgcgagcagccagccgcgcccgggcggcgacagcagcccggtggtggacagcggcccgggcccggcgagcaacctgacgagcgtgccggtgccgcacacgacggcgctgagcctgccggcgtgcccggaggagagcccgctgctggtgggcccgatgctgatcgagttcaacatgccggtggacctggagctggtggcgaagcagaacccgaacgtgaagatgggtggtcgttacgcgccgcgcgactgcgtgagcccgcacaaggtggcgatcatcatcccgttccgcaaccgccaggagcacctgaagtactggctgtactacctgcacccggtgctgcagcgccagcagctggactacggcatctacgtgatcaaccaggcgggcgacacgatcttcaaccgcgcgaagctgctgaacgtgggcttccaggaggcgctgaaggactacgactacacgtgcttcgtgttcagcgacgtggacctgatcccgatgaacgaccacaacgcgtaccgctgcttcagccagccgcgccacatcagcgtggcgatggacaagttcggcttcagcctgccgtacgtgcagtacttcggcggcgtgagcgcgctgagcaagcagcagttcctgacgatcaacggcttcccgaacaactactggggctggggcggcgaggacgacgacatcttcaaccgcctggtgttccgcggcatgagcatcagccgcccgaacgcggtggtgggccgctgccgcatgatccgccacagccgcgacaagaagaacgagccgaacccgcagcgcttcgaccgcatcgcgcacacgaaggagacgatgctgagcgacggcctgaacagcctgacgtaccaggtgctggacgtgcagcgctacccgctgtacacgcagatcacggtggacatcggcacgccgagctggtcccacccgcagttcgagaagtaagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccgcatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgaccgactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 15 - DNA, 9271 bp, Artificial Sequence
  pLMTB4939 (ssu::hMGAT1 3xHA; hyg marker (hygromycin resistance))
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctatgctgaagaagcagtccgccggcctggtcctgtggggcgccatcctgttcgtcgcctggaacgccctgctgctgctgttcttctggacccggcccgcccccggccggcccccctccgtctccgccctggacggcgaccccgcctccctgacccgggaggtcatccggctggcccaggacgccgaggtcgagctggagcggcagcggggcctgctgcagcagatcggcgacgccctgtcctcccagcggggccgggtccccaccgccgccccccccgcccagccccgggtccccgtcacccccgcccccgccgtcatccccatcctggtcatcgcctgcgaccggtccaccgtccggcggtgcctggacaagctgctgcactatcggccctccgccgagctgttccccatcatcgtctcccaggactgcggccacgaggagaccgcccaggccatcgcctcctatggctccgccgtcacccacatccggcagcccgacctgtcctccatcgccgtcccccccgaccaccggaagttccagggctattataagatcgcccggcactatcggtgggccctgggccaggtcttccggcagttccggttccccgccgccgtcgtcgtcgaggacgacctggaggtcgcccccgacttcttcgagtatttccgggccacctatcccctgctgaaggccgacccctccctgtggtgcgtctccgcctggaacgacaacggcaaggagcagatggtcgacgcctcccggcccgagctgctgtatcggaccgacttcttccccggcctgggctggctgctgctggccgagctgtgggccgagctggagcccaagtggcccaaggccttctgggacgactggatgcggcggcccgagcagcggcagggccgggcctgcatccggcccgaaatttctcggaccatgaccttcggccggaagggcgtctcccacggccagttcttcgaccagcacctgaagttcatcaagctgaaccagcagttcgtccacttcacccagctggacctgtcctatctgcagcgggaggcctatgaccgggacttcctggcccgggtctatggcgccccccagctgcaggtcgagaaggtccggaccaacgaccggaaggagctgggcgaggtccgggtccagtataccggccgggactccttcaaggccttcgccaaggccctgggcgtcatggacgacctgaagtccggcgtcccccgggccggctatcggggcatcgtcaccttccagttccggggccggcgggtccacctggccccccccctgacctgggagggctatgacccctcctggaacgcgggagcgtatccttatgacgtccctgattacgcatatccttatgacgtccctgattacgcatatccttatgacgtccctgattacgcataagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 16 - DNA, 8616 bp, Artificial Sequence
  pLMTB5175 (ssu::rMGAT2 3xHA; ble marker (zeocin resistance))
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctatgcggttccggatctataagcggaaggtcctgatcctgaccctggtcgtcgccgcctgcggcttcgtcctgtggtcctccaacggccggcagcggaagaacgacgccctggccccccccctgctggactccgagcccctgcggggcgccggccacttcgccgcctccgtcggcatccggcgggtctccaacgactccgccgcccccctggtccccgccgtcccccggcccgaggtcgacaacctgaccctgcggtatcggtccctggtctatcagctgaacttcgaccagatgctgcggaacgtcgacaaggacggcacctggtcccccggcgagctggtcctggtcgtccaggtccacaaccggcccgagtatctgcggctgctgatcgactccctgcggaaggcccagggcatccgggaggtcctggtcatcttctcccacgacttctggtccgccgagatcaactccctgatctcctccgtcgacttctgccccgtcctgcaggtcttcttccccttctccatccagctgtatccctccgagttccccggctccgacccccgggactgcccccgggacctgaagaagaacgccgccctgaagctgggctgcatcaacgccgagtatcccgactccttcggccactatcgggaggccaagttctcccagaccaagcaccactggtggtggaagctgcacttcgtctgggagcgggtcaaggtcctgcaggactataccggcctgatcctgttcctggaggaggaccactatctggcccccgacttctatcacgtcttcaagaagatgtggaagctgaagcagcaggagtgccccggctgcgacgtcctgtccctgggcacctataccaccatccggtccttctatggcatcgccgacaaggtcgacgtcaagacctggaagtccaccgagcacaacatgggcctggccctgacccgggacgcctatcagaagctgatcgagtgcaccgacaccttctgcacctatgacgactataactgggactggaccctgcagtatctgaccctggcctgcctgcccaaggtctggaaggtcctggtcccccaggccccccggatcttccacgccggcgactgcggcatgcaccacaagaagacctgccggccctccacccagtccgcccagatcgagtccctgctgaacaacaacaagcagtatctgttccccgagaccctggtcatcggcgagaagttccccatggccgccatctcccccccccggaagaacggcggctggggcgacatccgggaccacgagctgtgcaagtcctatcggcggctgcaggcgggagcgtatccttatgacgtccctgattacgcatatccttatgacgtccctgattacgcatatccttatgacgtccctgattacgcataagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccgcatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgaccgactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 17 - DNA, 10333 bp, Artificial Sequence
  pLMTB5026 (ssu::Rituximab_LMTB) ; sat marker (nourseothricin resistance)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattggagatcggtacttcgcgaatgcgtcgagatggtaccaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctgccatgatcgcgggcagcgtgcgccgcggcgtgatcctgctgctggtggcggtggcggtggcgacgatggcggcggcggtgagcgcggcgcagatcgtgctgagccagagcccggcgatcctgagcgcgagcccgggcgagaaggtgacgatgacgtgccgcgcgagcagcagcgtgagctacatccactggttccagcagaagccgggcagcagcccgaagccgtggatctacgcgacgagcaacctggcgagcggcgtgccggtgcgcttcagcggcagcggcagcggcacgagctacagcctgacgatcagccgcgtggaggcggaggacgcggcgacgtactactgccagcagtggacgagcaacccgccgacgttcggcggcggcacgaagctggagatcaagcgcacggtggcggcgccgagcgtgttcatcttcccgccgagcgacgagcagctgaagagcggcacggcgagcgtggtgtgcctgctgaacaacttctacccgcgcgaggcgaaggtgcagtggaaggtggacaacgcgctgcagagcggcaacagccaggagagcgtgacggagcaggacagcaaggacagcacgtacagcctgagcagcacgctgacgctgagcaaggcggactacgagaagcacaaggtgtacgcgtgcgaggtgacgcaccagggcctgagcagcccggtgacgaagagcttcaaccgcggcgagtgctgatcgagggaggaggaggaggcgcgtagcattgcgtgcgggttatgtgtgcgtgcgtgtgtgtgtgcggtgcgcgcctttcctcttttttttctccctctcgtcggttttttttttctgaggagacggggcgaagacgcgagcggggggcggcgtttgtgtgtgtgtgtgcgcgtgtcgggggcagcggtgttggcggaacggccaacgccctgccccctccccgccctgcgacgtttctgcgcacccgttctctccttcctgcgtgcgtgtctgcgcgcatgcacatctgtccgcgtgtgccgcagcgctggtatttttgtgagggcagagccctgcctccccgcctctctgccgttggcaggtgaagcgaaaacgaagcgagagggcagtctgcatgtgtgtgcgagggcatgcggagcccccctccccccgccccctgccgtgctgcaccgctattgtggcgtcttctctcgttgtgcgcaagtgtggctgcaccacggccgcctcatgtgcgtgtgtgcgcatgtacacacacacacacacacacacacacacacgggcaggcgcacgctcctctctcttcagggagcgccgccccgctggtgtcattggacgagcatccgccgcgcatctcttcacccctcacccctcatccctctcccctctccccgcacacacacgcagtccttcgctttcactcttcgaacaaacacctcaaccatcttatcacctttctctcttccttgtcaaccatgcgtgaggccatgatcgcgggcagcgtgcgccgcggcgtgatcctgctgctggtggcggtggcggtggcgacgatggcggcggcggtgagcgcggcgcaggtgcagctgcagcagccgggcgcggagctggtgaagccgggcgcgagcgtgaagatgagctgcaaggcgagcggctacacgttcacgagctacaacatgcactgggtgaagcagacgccgggccgcggcctggagtggatcggcgcgatctacccgggcaacggcgacacgagctacaaccagaagttcaagggcaaggcgacgctgacggcggacaagagcagcagcacggcgtacatgcagctgagcagcctgacgagcgaggacagcgcggtgtactactgcgcgcgcagcacgtactacggcggcgactggtacttcaacgtgtggggcgcgggcacgacggtgacggtgagcgcggcgagcacgaagggcccgagcgtgttcccgctggcgccgagcagcaagagcacgagcggcggcacggcggcgctgggctgcctggtgaaggactacttcccggagccggtgacggtgagctggaacagcggcgcgctgacgagcggcgtgcacacgttcccggcggtgctgcagagcagcggcctgtacagcctgagcagcgtggtgacggtgccgagcagcagcctgggcacgcagacgtacatctgcaacgtgaaccacaagccgagcaacacgaaggtggacaagaaggcggagccgaagagctgcgacaagacgcacacgtgcccgccgtgcccggcgccggagctgctgggcggcccgagcgtgttcctgttcccgccgaagccgaaggacacgctgatgatcagccgcacgccggaggtgacgtgcgtggtggtggacgtgagccacgaggacccggaggtgaagttcaactggtacgtggacggcgtggaggtgcacaacgcgaagacgaagccgcgcgaggagcagtacaacagcacgtaccgcgtggtgagcgtgctgacggtgctgcaccaggactggctgaacggcaaggagtacaagtgcaaggtgagcaacaaggcgctgccggcgccgatcgagaagacgatcagcaaggcgaagggccagccgcgcgagccgcaggtgtacacgctgccgccgagccgcgacgagctgacgaagaaccaggtgagcctgacgtgcctggtgaagggcttctacccgagcgacatcgcggtggagtgggagagcaacggccagccggagaacaactacaagacgacgccgccggtgctggacagcgacggcagcttcttcctgtacagcaagctgacggtggacaagagccgctggcagcagggcaacgtgttcagctgcagcgtgatgcacgaggcgctgcacaaccactacacgcagaagagcctgagcctgagcccgggcaagtgacctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatcctagtatgaagatttcggtgatccctgagcaggtggcggaaacattggatgctgagaaccatttcattgttcgtgaagtgttcgatgtgcacctatccgaccaaggctttgaactatctaccagaagtgtgagcccctaccggaaggattacatctcggatgatgactctgatgaagactctgcttgctatggcgcattcatcgaccaagagcttgtcgggaagattgaactcaactcaacatggaacgatctagcctctatcgaacacattgttgtgtcgcacacgcaccgaggcaaaggagtcgcgcacagtctcatcgaatttgcgaaaaagtgggcactaagcagacagctccttggcatacgattagagacacaaacgaacaatgtacctgcctgcaatttgtacgcaaaatgtggctttactctcggcggcattgacctgttcacgtataaaactagacctcaagtctcgaacgaaacagcgatgtactggtactggttctcgggagcacaggatgacgcctaactagcctcggagatccactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttggtaccatcggatgccgggaccgacgagtgcagaggcgtgcaagcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 18 - DNA, 1475 bp, Artificial Sequence
  P16_383_1 (90MG1-SfGnT-I-3HA-Strep)
aataagatctatgctgaagaagcagagcgcgggcctggtgctgtggggcgcgatcctgttcgtggcgtggaacgcgctgctgctgctgttcttctggacgcgcccggcgccgggccgcccgccgagcgtgagcgcgctggacggcgacccggcgagcctgacgcgcgaggtgatccgcctggcgcaggacgcggaggtggagctggagcgccagcgcggcctgctgcagcagatcggcgacgcgctgagcagccagcgcggccgcgtgccgacggcggcggaggtgatgcagcacctgagccagccgatcctgccggtgctggtgatcgcgtgcgaccgcgtgacggtgcagcgctgcctggacaacctggtgaagttccgcccgagcaaggagacgttcccgatcatcgtgagccaggactgcggccacaacgcgacgtacgaggtgatcacgagctacacggcgagcgacccgacgatcagcgtggtgcgccagccggacctgagcgagatcgtgctgccgcgcgtgaaggtgaagttccgcggctactacaagatcgcgcgccactacaagttcgcgctgaaccacgtgttcgagacgctgggccacgaggcggtgatcatcgtggaggacgacctggacatcagcccggacttcttcgagtacttcctgggcacgtacccgctgctgctgaaggacccgagcctgtggtgcatcagcgcgtggaacgacaacggcaagatggaggtgatcgacatgagccgcccggacctgctgcaccgcacggacttcttcccgggcctgggctgggtgctgcgccgcgagatgtggcgcaagctggcgccgaagtggccgacggcgttcttcgacgactggctgcgcaacccggtgaacatcgacggcaaggcgtgcatccgcccggagatcagccgcacgtacagcttcggcaaggtgggcgtgagcaagggcctgttcttcgacctgcacctgcgcaacatccagctgaacatggagtacgtggagttcacgaagctgaacctgacgtacctgctgaaggagcactacgacgacgcgctggtgagcacggtgtacaacctgccggagatgagcgcgagcgaggtggtggcgggcagcgacctgagcgcggacccggtgcgcgtgatgtacagcaacgcgaagacgtaccagcgcgcggcgaagaagctgggcctgatggacgacttccgcagcggcgtgccgcgcacggcgtaccgcggcatcgtgacgtgcttcatccgcggccgccgcgtgtacctggcgccgagcttcgagtggaacaagtacgacccgacgtggggcgcgggcgcgtacccgtacgacgtgccggactacgcgtacccgtacgacgtgccggactacgcgtacccgtacgacgtgccggactacgcggcgggcgcgtggagccacccgcagttcgagaagtgagctagcaata

SEQ ID NO: 19 - DNA, 1475 bp, Artificial Sequence
  P16_383_2 (110MG1-SfGnT-I-3HA-Strep)
aataagatctatgctgaagaagcagagcgcgggcctggtgctgtggggcgcgatcctgttcgtggcgtggaacgcgctgctgctgctgttcttctggacgcgcccggcgccgggccgcccgccgagcgtgagcgcgctggacggcgacccggcgagcctgacgcgcgaggtgatccgcctggcgcaggacgcggaggtggagctggagcgccagcgcggcctgctgcagcagatcggcgacgcgctgagcagccagcgcggccgcgtgccgacggcggcgccgccggcgcagccgcgcgtgccggtgacgccggcgccggcggtgatcccgatcctggtggtgacggtgcagcgctgcctggacaacctggtgaagttccgcccgagcaaggagacgttcccgatcatcgtgagccaggactgcggccacaacgcgacgtacgaggtgatcacgagctacacggcgagcgacccgacgatcagcgtggtgcgccagccggacctgagcgagatcgtgctgccgcgcgtgaaggtgaagttccgcggctactacaagatcgcgcgccactacaagttcgcgctgaaccacgtgttcgagacgctgggccacgaggcggtgatcatcgtggaggacgacctggacatcagcccggacttcttcgagtacttcctgggcacgtacccgctgctgctgaaggacccgagcctgtggtgcatcagcgcgtggaacgacaacggcaagatggaggtgatcgacatgagccgcccggacctgctgcaccgcacggacttcttcccgggcctgggctgggtgctgcgccgcgagatgtggcgcaagctggcgccgaagtggccgacggcgttcttcgacgactggctgcgcaacccggtgaacatcgacggcaaggcgtgcatccgcccggagatcagccgcacgtacagcttcggcaaggtgggcgtgagcaagggcctgttcttcgacctgcacctgcgcaacatccagctgaacatggagtacgtggagttcacgaagctgaacctgacgtacctgctgaaggagcactacgacgacgcgctggtgagcacggtgtacaacctgccggagatgagcgcgagcgaggtggtggcgggcagcgacctgagcgcggacccggtgcgcgtgatgtacagcaacgcgaagacgtaccagcgcgcggcgaagaagctgggcctgatggacgacttccgcagcggcgtgccgcgcacggcgtaccgcggcatcgtgacgtgcttcatccgcggccgccgcgtgtacctggcgccgagcttcgagtggaacaagtacgacccgacgtggggcgcgggcgcgtacccgtacgacgtgccggactacgcgtacccgtacgacgtgccggactacgcgtacccgtacgacgtgccggactacgcggcgggcgcgtggagccacccgcagttcgagaagtgagctagcaata

SEQ ID NO: 20 - DNA, 1475 bp, Artificial Sequence
  P16_383_3 (130MG1-SfGnT-I-3HA-Strep)
aataagatctatgctgaagaagcagagcgcgggcctggtgctgtggggcgcgatcctgttcgtggcgtggaacgcgctgctgctgctgttcttctggacgcgcccggcgccgggccgcccgccgagcgtgagcgcgctggacggcgacccggcgagcctgacgcgcgaggtgatccgcctggcgcaggacgcggaggtggagctggagcgccagcgcggcctgctgcagcagatcggcgacgcgctgagcagccagcgcggccgcgtgccgacggcggcgccgccggcgcagccgcgcgtgccggtgacgccggcgccggcggtgatcccgatcctggtgatcgcgtgcgaccgcagcacggtgcgccgctgcctggacaagctgctgcactaccgcccgccgatcatcgtgagccaggactgcggccacaacgcgacgtacgaggtgatcacgagctacacggcgagcgacccgacgatcagcgtggtgcgccagccggacctgagcgagatcgtgctgccgcgcgtgaaggtgaagttccgcggctactacaagatcgcgcgccactacaagttcgcgctgaaccacgtgttcgagacgctgggccacgaggcggtgatcatcgtggaggacgacctggacatcagcccggacttcttcgagtacttcctgggcacgtacccgctgctgctgaaggacccgagcctgtggtgcatcagcgcgtggaacgacaacggcaagatggaggtgatcgacatgagccgcccggacctgctgcaccgcacggacttcttcccgggcctgggctgggtgctgcgccgcgagatgtggcgcaagctggcgccgaagtggccgacggcgttcttcgacgactggctgcgcaacccggtgaacatcgacggcaaggcgtgcatccgcccggagatcagccgcacgtacagcttcggcaaggtgggcgtgagcaagggcctgttcttcgacctgcacctgcgcaacatccagctgaacatggagtacgtggagttcacgaagctgaacctgacgtacctgctgaaggagcactacgacgacgcgctggtgagcacggtgtacaacctgccggagatgagcgcgagcgaggtggtggcgggcagcgacctgagcgcggacccggtgcgcgtgatgtacagcaacgcgaagacgtaccagcgcgcggcgaagaagctgggcctgatggacgacttccgcagcggcgtgccgcgcacggcgtaccgcggcatcgtgacgtgcttcatccgcggccgccgcgtgtacctggcgccgagcttcgagtggaacaagtacgacccgacgtggggcgcgggcgcgtacccgtacgacgtgccggactacgcgtacccgtacgacgtgccggactacgcgtacccgtacgacgtgccggactacgcggcgggcgcgtggagccacccgcagttcgagaagtgagctagcaata

SEQ ID NO: 21 - DNA, 1475 bp, Artificial Sequence
  P16_383_4 (150MG1-SfGnT-I-3HA-Strep)
aataagatctatgctgaagaagcagagcgcgggcctggtgctgtggggcgcgatcctgttcgtggcgtggaacgcgctgctgctgctgttcttctggacgcgcccggcgccgggccgcccgccgagcgtgagcgcgctggacggcgacccggcgagcctgacgcgcgaggtgatccgcctggcgcaggacgcggaggtggagctggagcgccagcgcggcctgctgcagcagatcggcgacgcgctgagcagccagcgcggccgcgtgccgacggcggcgccgccggcgcagccgcgcgtgccggtgacgccggcgccggcggtgatcccgatcctggtgatcgcgtgcgaccgcagcacggtgcgccgctgcctggacaagctgctgcactaccgcccgagcgcggagctgttcccgatcatcgtgagccaggactgcggccacgaggagacggcgcagacggcgagcgacccgacgatcagcgtggtgcgccagccggacctgagcgagatcgtgctgccgcgcgtgaaggtgaagttccgcggctactacaagatcgcgcgccactacaagttcgcgctgaaccacgtgttcgagacgctgggccacgaggcggtgatcatcgtggaggacgacctggacatcagcccggacttcttcgagtacttcctgggcacgtacccgctgctgctgaaggacccgagcctgtggtgcatcagcgcgtggaacgacaacggcaagatggaggtgatcgacatgagccgcccggacctgctgcaccgcacggacttcttcccgggcctgggctgggtgctgcgccgcgagatgtggcgcaagctggcgccgaagtggccgacggcgttcttcgacgactggctgcgcaacccggtgaacatcgacggcaaggcgtgcatccgcccggagatcagccgcacgtacagcttcggcaaggtgggcgtgagcaagggcctgttcttcgacctgcacctgcgcaacatccagctgaacatggagtacgtggagttcacgaagctgaacctgacgtacctgctgaaggagcactacgacgacgcgctggtgagcacggtgtacaacctgccggagatgagcgcgagcgaggtggtggcgggcagcgacctgagcgcggacccggtgcgcgtgatgtacagcaacgcgaagacgtaccagcgcgcggcgaagaagctgggcctgatggacgacttccgcagcggcgtgccgcgcacggcgtaccgcggcatcgtgacgtgcttcatccgcggccgccgcgtgtacctggcgccgagcttcgagtggaacaagtacgacccgacgtggggcgcgggcgcgtacccgtacgacgtgccggactacgcgtacccgtacgacgtgccggactacgcgtacccgtacgacgtgccggactacgcggcgggcgcgtggagccacccgcagttcgagaagtgagctagcaata

SEQ ID NO: 22 - DNA, 2420 bp, Artificial Sequence
  P16_383_5 (MGAT2-Strep-SfGnT-I-3xHA)
aataagatctatgcgcttccgcatctacaagcgcaaggtgctgatcctgacgctggtggtggcggcgtgcggcttcgtgctgtggagcagcaacggccgccagcgcaagaacgacgcgctggcgccgccgctgctggacagcgagccgctgcgcggcgcgggccacttcgcggcgagcgtgggcatccgccgcgtgagcaacgacagcgcggcgccgctggtgccggcggtgccgcgcccggaggtggacaacctgacgctgcgctaccgcagcctggtgtaccagctgaacttcgaccagatgctgcgcaacgtggacaaggacggcacgtggagcccgggcgagctggtgctggtggtgcaggtgcacaaccgcccggagtacctgcgcctgctgatcgacagcctgcgcaaggcgcagggcatccgcgaggtgctggtgatcttcagccacgacttctggagcgcggagatcaacagcctgatcagcagcgtggacttctgcccggtgctgcaggtgttcttcccgttcagcatccagctgtacccgagcgagttcccgggcagcgacccgcgcgactgcccgcgcgacctgaagaagaacgcggcgctgaagctgggctgcatcaacgcggagtacccggacagcttcggccactaccgcgaggcgaagttcagccagacgaagcaccactggtggtggaagctgcacttcgtgtgggagcgcgtgaaggtgctgcaggactacacgggcctgatcctgttcctggaggaggaccactacctggcgccggacttctaccacgtgttcaagaagatgtggaagctgaagcagcaggagtgcccgggctgcgacgtgctgagcctgggcacgtacacgacgatccgcagcttctacggcatcgcggacaaggtggacgtgaagacgtggaagagcacggagcacaacatgggcctggcgctgacgcgcgacgcgtaccagaagctgatcgagtgcacggacacgttctgcacgtacgacgactacaactgggactggacgctgcagtacctgacgctggcgtgcctgccgaaggtgtggaaggtgctggtgccgcaggcgccgcgcatcttccacgcgggcgactgcggcatgcaccacaagaagacgtgccgcccgagcacgcagagcgcgcagatcgagagcctgctgaacaacaacaagcagtacctgttcccggagacgctggtgatcggcgagaagttcccgatggcggcgatcagcccgccgcgcaagaacggcggctggggcgacatccgcgaccacgagctgtgcaagagctaccgccgcctgcaggcgggcgcgtggagccacccgcagttcgagaaggcgggcgcgccgatcatcgtgagccaggactgcggccacaacgcgacgtacgaggtgatcacgagctacacggcgagcgacccgacgatcagcgtggtgcgccagccggacctgagcgagatcgtgctgccgcgcgtgaaggtgaagttccgcggctactacaagatcgcgcgccactacaagttcgcgctgaaccacgtgttcgagacgctgggccacgaggcggtgatcatcgtggaggacgacctggacatcagcccggacttcttcgagtacttcctgggcacgtacccgctgctgctgaaggacccgagcctgtggtgcatcagcgcgtggaacgacaacggcaagatggaggtgatcgacatgagccgcccggacctgctgcaccgcacggacttcttcccgggcctgggctgggtgctgcgccgcgagatgtggcgcaagctggcgccgaagtggccgacggcgttcttcgacgactggctgcgcaacccggtgaacatcgacggcaaggcgtgcatccgcccggagatcagccgcacgtacagcttcggcaaggtgggcgtgagcaagggcctgttcttcgacctgcacctgcgcaacatccagctgaacatggagtacgtggagttcacgaagctgaacctgacgtacctgctgaaggagcactacgacgacgcgctggtgagcacggtgtacaacctgccggagatgagcgcgagcgaggtggtggcgggcagcgacctgagcgcggacccggtgcgcgtgatgtacagcaacgcgaagacgtaccagcgcgcggcgaagaagctgggcctgatggacgacttccgcagcggcgtgccgcgcacggcgtaccgcggcatcgtgacgtgcttcatccgtggtcgtcgcgtgtacctggcgccgagcttcgagtggaacaagtacgacccgacgtggggcgcgggcgcgtacccgtacgacgtgccggactacgcgtacccgtacgacgtgccggactacgcgtacccgtacgacgtgccggactacgcgtgagctagcaata

SEQ ID NO: 23 - DNA, 2510 bp, Artificial Sequence
  P16_407_9 (MGAT2-Strep-MGhybrSfGnT1-3xHA cuo)
atatagatctatgcgcttccgcatctacaagcgcaaggtgctgatcctgacgctggtggtggcggcgtgcggcttcgtgctgtggagcagcaacggccgccagcgcaagaacgacgcgctggcgccgccgctgctggacagcgagccactgcgcggtgcgggtcacttcgcggcgagcgtgggcatccgccgcgtgagcaacgacagcgcagcaccgctggtgccggcagtgccacgcccagaggtggacaacctgacgctgcgctaccgcagcctggtgtaccagctgaacttcgaccagatgctgcgcaacgtggacaaggacggcacgtggagcccgggcgagctggtgctggtggtgcaggtgcacaaccgcccagagtacctgcgcctgctgatcgacagcctgcgcaaggcgcagggcatccgcgaggtgctggtgatcttcagccacgacttctggagcgcggagatcaacagcctgatcagcagcgtggacttctgcccggtgctgcaggtgttcttcccgttcagcatccagctgtacccgagcgagttcccaggaagcgacccgcgcgactgcccgcgcgacctgaagaagaacgcggcgctgaagctgggctgcatcaacgcggagtacccggacagcttcggccactaccgcgaggcgaagttcagccagacgaagcaccactggtggtggaagctgcacttcgtgtgggagcgcgtgaaggtgctgcaggactacacgggcctgatcctgttcctggaggaggaccactacctggcgccggacttctaccacgtgttcaagaagatgtggaagctgaagcagcaggagtgcccgggctgcgacgtgctgagcctgggcacgtacacgacgatccgcagcttctacggcatcgcggacaaggtggacgtgaagacgtggaagagcacggagcacaacatgggcctggcgctgacgcgcgacgcgtaccagaagctgatcgagtgcacggacacgttctgcacgtacgacgactacaactgggactggacgctgcagtacctgacgctggcgtgcctgccgaaggtgtggaaggtgctggtgccgcaggcgccgcgcatcttccacgcgggcgactgcggcatgcaccacaagaagacgtgccgcccgagcacgcagagcgcgcagatcgagagcctgctgaacaacaacaagcagtacctgttcccggagacgctggtgatcggcgagaagttcccgatggcggcgatcagcccaccgcgcaagaacggtggctggggtgacatccgcgaccacgagctgtgcaagagctaccgccgcctgcaggcaggtgcgtggagccacccgcagttcgagaaggcaggtgcaccggcaccggcggtgatcccgatcctggtgatcgcgtgcgaccgcagcacggtgcgccgctgcctggacaagctgctgcactaccgcccgagcgcggagctgttcccgatcatcgtgagccaggactgcggccacgaggagacggcgcagacggcgagcgacccgacgatcagcgtggtgcgccagccggacctgagcgagatcgtgctgccacgcgtgaaggtgaagttccgcggctactacaagatcgcgcgccactacaagttcgcactgaaccacgtgttcgagacgctgggccacgaggcggtgatcatcgtggaggacgacctggacatcagcccggacttcttcgaatacttcctgggcacgtacccgctgctgctgaaggacccgagcctgtggtgcatcagcgcgtggaacgacaacggcaagatggaggtgatcgacatgagccgcccggacctgctgcaccgcacggacttcttcccaggcctgggctgggtgctgcgccgcgagatgtggcgcaagctggcgccgaagtggccgacggcgttcttcgacgactggctgcgcaacccggtgaacatcgacggcaaggcgtgcatccgcccagagatcagccgcacgtacagcttcggcaaggtgggcgtgagcaagggcctgttcttcgacctgcacctgcgcaacatccagctgaacatggagtacgtggagttcacgaagctgaacctgacgtacctgctgaaggagcactacgacgacgcgctggtgagcacggtgtacaacctgccggagatgagcgcgagcgaggtggtggcgggcagcgacctgagcgcagacccggtgcgcgtgatgtacagcaacgcgaagacgtaccagcgcgcggcgaagaagctgggcctgatggacgacttccgcagcggtgtgccacgcacggcgtaccgcggcatcgtgacgtgcttcatccgcggtcgccgcgtgtacctggcgccgagcttcgagtggaacaagtacgacccgacgtggggtgcgggagcgtacccgtacgacgtgccggactacgcgtacccgtacgacgtgccggactacgcgtacccgtacgacgtgccggactacgcgtgagctagcatat

SEQ ID NO: 24 - protein, 45 aa, L. tarentolae
  MAN1 CTS (MAN1 (LTAR_090021500.1))
MQRQRIRHHLRFVDRYIVLAVLGVVVYILVVSLIAESLAIGVRDR

SEQ ID NO: 25 - protein, 47 aa, L. tarentolae
  NPTDase 1 CTS (LtaNTPDase1 (LTAR_150005200.1TBA))
MRPNLSVRRMTHQWKRLRVTGTLVLSALVLFAFVVYYQSPSFSPCDS

SEQ ID NO: 26 - protein, 80 aa, L. tarentolae
  NPTDase 2 CTS (LtaNTPDase2 (LTAR_100006700.1))
MAASTCERGWLQRFACASPIRNTLSRIFSAPMEARATGGRLRGSTRRAVAVFFTAVFAVVFLTVYEVGIGVANPHQSLHT

SEQ ID NO: 27 - protein, 193 aa, L. tarentolae
  GRIP (GRIP (LTAR_110005600.1))
KRASTQAERVPQLEQETNELRTRCDLLRKELQRQREAMQPERSQLYETARSEATASSATENVGAVQSALLAAAGCVSERDVVTFVGHRSLQDGSVKLSKAAAEQLRKENTELKRENAHNNTVIAQYIRELEGYKANERVQLSIEYLRNIVHQYLCAAEDLRPKMIPAICTVLEFSSKQKEDVQAANVRCPQFH

SEQ ID NO: 28 - protein, 26 aa, L. tarentolae
  LTAR_040008100.1 (previously LtaP04.0290) Invertase secretion signal
MIASSVRHAVILLLVAVAMMAAAVIA

SEQ ID NO: 29 - protein, 29 aa, Artificial Sequence
  Modified Invertase secretion signal peptide
MIAGSVRRGVILLLVAVAVATMAAAVSAA

SEQ ID NO: 30 - protein, 447 aa, Homo sapiens
  alpha-1,6-mannosyl-glycoprotein 2-beta-N- acetylglucosaminyltransferase
MRFRIYKRKVLILTLVVAACGFVLWSSNGRQRKNEALAPPLLDAEPARGAGGRGGDHPSVAVGIRRVSNVSAASLVPAVPQPEADNLTLRYRSLVYQLNFDQTLRNVDKAGTWAPRELVLVVQVHNRPEYLRLLLDSLRKAQGIDNVLVIFSHDFWSTEINQLIAGVNFCPVLQVFFPFSIQLYPNEFPGSDPRDCPRDLPKNAALKLGCINAEYPDSFGHYREAKFSQTKHHWWWKLHFVWERVKILRDYAGLILFLEEDHYLAPDFYHVFKKMWKLKQQECPECDVLSLGTYSASRSFYGMADKVDVKTWKSTEHNMGLALTRNAYQKLIECTDTFCTYDDYNWDWTLQYLTVSCLPKFWKVLVPQIPRIFHAGDCGMHHKKTCRPSTQSAQIESLLNNNKQYMFPETLTISEKFTVVAISPPRKNGGWGDIRDHELCKSYRRLQ

SEQ ID NO: 31 - protein, 447 aa, Pan paniscus
  alpha-1,6-mannosyl-glycoprotein 2-beta-N- acetylglucosaminyltransferase isoform 1
MRFRIYKRKVLILTLVVAACGFVLWSSNGRQRKNEALAPPLLDAEPARGAGGRGGDHPSVAVGIRRVSNVSAAPLVPAVPQPEADNLTLRYRSLVYQLNFDQTLRNVDKAGTWAPRELVLVVQVHNRPEYLRLLLDSLRKAQGIDNVLVIFSHDFWSTEINQLIAGVNFCPVLQVFFPFSIQLYPNEFPGSDPRDCPRDLPKNAALKLGCINAEYPDSFGHYREAKFSQTKHHWWWKLHFVWERVKILRDYAGLILFLEEDHYLAPDFYHVFKKMWKLKQQECPECDVLSLGTYSASRSFYGMADKVDVKTWKSTEHNMGLALTRNAYQKLIECTDTFCTYDDYNWDWTLQYLTVSCLPKFWKVLVPQVPRIFHAGDCGMHHKKTCRPSTQSAQIESLLNNNKQYMFPETLTISEKFTVVAISPPRKNGGWGDIRDHELCKSYRRLQ

SEQ ID NO: 32 - protein, 446 aa, Canis lupus familiaris
  alpha-1,6-mannosyl-glycoprotein 2-beta-N- acetylglucosaminyltransferase
MRFRIYKRKVLILTLVVAACGFVLWSSNGRQRKNEALAPPLLDAEPARGAGGRGGDHSAVSVGIRRGSNESAAPLVPAAPQPEADNLTLRYRSLVYQLNFDQTLRNVDKAGSWAPRELVLVVQVHNRPDYLRLLLDSLRKAQGIDNVLVIFSHDFWSTEINQLIAGVDFCPVLQVFFPFSIQLYPNEFPGSDPRDCPRDLEKNAALKMGCINAEYPDSFGHYREAKFSQTKHHWWWKLHFVWERVKVLRDYAGLILFLEEDHYLAPDFYHVFKKMWKLKQEECPECDVLSLGTYTAIRSFHGIADKVDVKTWKSTEHNMGLALTRDAYQKLIECTDTFCTYDDYNWDWTLQYLTVSCLPKFWKVLVPQVPRIFHAGDCGMHHKKTCKPSTQSAQIESLLNSNKQYLFPETLIISEKFVAAISPPRKNGGWGDIRDHELCKSYRRLQ

SEQ ID NO: 33 - protein, 446 aa, Bos taurus
  alpha-1,6-mannosyl-glycoprotein 2-beta-N- acetylglucosaminyltransferase
MRFRIYKRKVLILMLVVAACGFVLWSSNGRQRKNEALAPPLLDADPVRGAGARAGDHPAVSVGIRRGSNESAAPLVAAAPQPEVDNLTLRYRSLVYQLNFDQTLRNVDKAASWTPRELALVVQVHNRPEYLKLLLDSLRKAQGIDDVLVIFSHDFWSTEINQLIAGVDFCPVLQVFFPFSIQLYPNEFPGTDPRDCPRDMEKNAALRMGCINAEYPDSFGHYREAKFSQTKHHWWWKLHFVWERVKVLRDYAGLILFLEEDHYLAPDFYHVFKKMWKLKQLECPECDVLSLGTYTAIRNFYDVADKVDVKTWKSTEHNMGLALTREAYQKLIECTDTFCTYDDYNWDWTLQYLTVSCLPKFWKVLVPQVPRIFHAGDCGMHHQKTCRPATQSAQLESLLNNNKQYLFPETLTISEKFMTSLSPPRKNGGWGDIRDHELCKSYRRLQ

SEQ ID NO: 34 - protein, 442 aa, Mus musculus
  alpha-1,6-mannosyl-glycoprotein 2-beta-N- acetylglucosaminyltransferase
MRFRIYKRKVLILTLVVAACGFVLWSSNGRQRKSDALGPPLLDAEPVRGAGHLAVSVGIRRVSNESAAPLVPAVPRPEVDNLTLRYRSLVYQLNFDQMLRNVGNDGTWSPGELVLVVQVHNRPEYLRLLIDSLRKAQGIQEVLVIFSHDFWSAEINSLISRVDFCPVLQVFFPFSIQLYPNEFPGSDPRDCPRDLKKNAALKLGCINAEYPDSFGHYREAKFSQTKHHWWWKLHFVWERVKVLQDYTGLILFLEEDHYLAPDFYHVFKKMWKLKQQECPGCDVLSLGTYTTIRSFYGIADKVDVKTWKSTEHNMGLALTRDAYQKLIECTDTFCTYDDYNWDWTLQYLTLACLPKIWKVLVPQAPRIFHAGDCGMHHKKTCRPSTQSAQIESLLNSNKQYLFPETLVIGEKFPMAAISPPRKNGGWGDIRDHELCKSYRRLQ

SEQ ID NO: 35 - protein, 442 aa, Rattus norvegicus
  alpha-1,6-mannosyl-glycoprotein 2-beta-N- acetylglucosaminyltransferase
MRFRIYKRKVLILTLVVAACGFVLWSSNGRQRKNDALAPPLLDSEPLRGAGHFAASVGIRRVSNDSAAPLVPAVPRPEVDNLTLRYRSLVYQLNFDQMLRNVDKDGTWSPGELVLVVQVHNRPEYLRLLIDSLRKAQGIREVLVIFSHDFWSAEINSLISSVDFCPVLQVFFPFSIQLYPSEFPGSDPRDCPRDLKKNAALKLGCINAEYPDSFGHYREAKFSQTKHHWWWKLHFVWERVKVLQDYTGLILFLEEDHYLAPDFYHVFKKMWKLKQQECPGCDVLSLGTYTTIRSFYGIADKVDVKTWKSTEHNMGLALTRDAYQKLIECTDTFCTYDDYNWDWTLQYLTLACLPKVWKVLVPQAPRIFHAGDCGMHHKKTCRPSTQSAQIESLLNNNKQYLFPETLVIGEKFPMAAISPPRKNGGWGDIRDHELCKSYRRLQ

SEQ ID NO: 36 - protein, 281 aa, Gallus gallus
  alpha-1,6-mannosyl-glycoprotein 2-beta-N- acetylglucosaminyltransferase
MASPAANEEAAALDAGALWRAATWERGAAAARTRKAAALRLGCLNAEFPDSFGHYREARFSQTKHHWWWKLHFVWERVRALREHAGPVVFLEEDHYLAPDFYHVLKRLWALRQRDCPECQVVSLGSYAVGRGGFAGRADKAEVKTWKSTEHNMGMAFGRDTYQKLIECTDAFCTYDDYNWDWTLQHLTVSCLPKFWKVLVPEIPRVFHTGDCGMHHKKSCRPSSQSAKIDSLLSSNRQYLFPETMSVSKRYSMAPLSPHVKNGGWGDIRDHELCKSYRRLQ

SEQ ID NO: 37 - protein, 450 aa, Danio rerio
  alpha-1,6-mannosyl-glycoprotein 2-beta- acetylglucosaminyltransferase
MRFRIYKRKVVILTLVVIICGFAVWNSGKPKKASTVFPKEVETVKRSSVGSQIQATIPVTRKPINESIPEKQQQQQPVAKSEADNTTLVYRGIVFQLNFDQNLKNEEKFRAVRQKDDLVIVVQVHNRPEYLRLLVDSLRKSKGIENILLIFSHDFWSPEINQIVASVDFCLVLQIFFPFSIQLYPQEFPGNDPRDCPRDIPKKEALTLGCINAEYPDSFGHYREAKFSQTKHHWWWKLHFVWDRVRVLKDHKGLVLLIEEDHYLAPDFYHLLKLMASLKKEQCPDCDILSLGSYGHIGYSSKANKVEVKAWKSTEHNMGMALNRDAYQKLLRCTDAFCTYDDYNWDWSLQHLTVTCLPAFLKVMVSEAPRIFHAGDCGMHHKKSACMPSGQKTKIENVLQNSGNQLFPKQLLITKRLPASGAKGVAPHVKNGGWGDIRDHELCKSYLRLQ

SEQ ID NO: 38 - protein, 608 aa, Drosophila melanogaster
  Mgat2 isoform A
MSKMRGRILIPLPNTGAMGRKRNNFYMRSLFLLALGIFGLLQYNNFNYLDSRDNVLGDAVTNDSDDAILAMVPATLHKYLTPHSRNHSASGAGALNGAALLLNASSPGAATASTISFDVYHPPNITEIKRQIVRYNDMQMVLNEDVFGPLQNDSVIIVVQVHTRITYLRHLIVSLAQARDISKVLLVFSHDYYDDDINDLVQQIDFCKVMQIFYPYSIQTHPNEYPGVDPNDCPRNIKKEQALITNCNNAMYPDLYGHYREAKFTQTKHHWIWKANRVFNELEVTRYHTGLVLFLEEDHYVAEDFLYLLAMMQQRTKDLCPQCNVLSLGTYLKTFNYYTYHSKTNKKSYASSLISTNSLLGYNRNNNRNSVQLAVSSSYSSSSSAQSPPPSKVYVGDTSDNQRASDSSSRRGNLINTVTDTATATAATSDTSNNEQSSHSSSKNGAQTWNYHVLPSLYSVYQKVEVMPWVSSKHNMGFAFNRTTWSNIRKCARHFCTYDDYNWDWSLQHVSQQCLRRKLHAMIVKGPRVFHIGECGVHHKNKNCESNQVISKVQHVLRIARNSHQLFPRSLTLTVPSLMKKSKLRKGNGGWGDMRDHELCLNMTLATR

SEQ ID NO: 39 - protein, 717 aa, Anopheles gambiae str. PEST
  AGAP004397-PA
MTTMLAVSPPARPWDALGRRIPIALPNTGALSRRRHTLYIRSAIIIFILFAFLQFHVINYDSSDSGSSDNANYSTAAILQMVPPVFHKYLTGKPRNSTHGQNGTHYAGDGPRTANISDIMRMINRYNDLQTVLNEDIYGPLQNDSVIIVVQLLPLYLLHPLRVIPVVVVVVVHKRITYLRHLIVSLAQARGISRTLLVFSHDYYDDDINDLVQSIDFCKVIQIFYPFSIQTHPTEFPGADPGDCPRDIKKEQALLRKCNNALHPDLYGHYREAKFTQTKHHWWWKANRVFDQLEVTKYHTGMMVFLEEDHYVAEDFLYILELMFRKSQDLCPKCNILSLGTYLKTFNYYTYNKKRTQPYRGGWYPGNAAKVGTVREGLQASAALREQGSFGSFAGSYSTLSRSQLKDAARRIRATVDVSTLLDQNQKTLRRSPPDLPAWYDRPQVALIGQSAAHVNDISINAKRNGFLNHPSNSPSRQHNNNNPWQQWRPLQHQQQQKLLQQQRQLQQQQQLMLQKQRQQQQHQQQQQQQQQQQDQLSQQQSLQTQVTTEKYASQSQWGYQVLPTLYSIYQKVEVTPWISSKHNMGMAFNRTTWYEIVRCARHFCEYDDYNWDWSLQHVSQQCLKQKLHVMVVKGPRVFHIGECGVHHKKSNCESNQVISKVQQVLKVARGAQQLFPRSISLTQTSVIKKTKLRKGNGGWGDQRDHQLCFNMTLVGR

SEQ ID NO: 40 - protein, 487 aa, Caenorhabditis elegans
  gly20 - GLYcosylation related
MMVYRRMHRLANAVIACCLFGFIVIFLKAPGEDQRLRDGVPVLSQNPVWSVNDWNGLNKEVVDLLKNESNRLSINEKPDLSGWNFKTKEDMSLKGSEIVESVSFLNENFDILNAAKFGDLSTVKTILVIQVHDRPVYLQYLIESMRNTKGIEDTLLVFSHDINVGIINEMIRNITFARVYQIFYPYNLQLFPTVFPGQSPSDCPEKMKRDKAQETNCSNWSSPDKYGNYRVAQLTQIKHHWWWKMNFVFDGIVEKYSMKDPWVLLLEEDHMLAPDALHVLDIIVSNRPKYCENCEIISLGFYLKSTNKYGQDIAHLGVHPWYSSKHNMGMALQKNTWQKIKGCSEMFCKWDDYNWDWSLMQISAKCLPQRFRVIFTKSPRVIHIGDCGVHTHRCEAHKALQSTQELFRQHKDLLFPTSLSVTDTSRRSLKPSKENGGWGDIRDRQLCEINKSPLVRVSSQSASVLHKLLNSKIQFSSSNKTITSTTS

SEQ ID NO: 41 - protein, 430 aa, Arabidopsis thaliana
  beta-1,2-N-acetylglucosaminyltransferase II
MANLWKKQRLRDTGLCRLGILFAVTLSIVLMLVSVPRTALNGSSIDDDLDGLDKDLEAKLNASLLSVARGNRMSLRLHRRNHFSPRNTDLFPDLAKDRVVIVLYVHNRAQYFRVTVESLSKVKGISETLLIVSHDGYFEEMNRIVESIKFCQVKQIFSPYSPHIYRTSFPGVTLNDCKNKGDEAKGHCEGNPDQYGNHRSPKIVSLKHHWWWMMNTVWDGLEETKGHEGHILFIEEDHFLFPNAYRNIQTLTRLKPAKCPDCFAANLAPSDVKSRGEGLESLVAERMGNVGYSFNRSVWENIHQKAREFCFFDDYNWDITMWATVFPSFGSPVYTLRGPRTSAVHFGKCGLHQGRGDEGDCIDNGVVNIEVKETDKVVNIKEGWGVRVYKHQAGYKAGFEGWGGWGDDRDRHLCLDFATMYRYSSSSASP

SEQ ID NO: 42 - protein, 432 aa, Xenopus tropicalis
  alpha-1,6-mannosyl-glycoprotein 2-beta- acetylglucosaminyltransferase
MRCRIYKRKVIILTLVVVACGLALWSSGRQKKNGFVPEVETDRFQSKGHISPAARKASNESLANKEQKAKVDNMTLAYRSVVFQWNFDQAIRNVEKINRPQDDVVVVVQVHNRPEFLKRLLDSLGKAKGIENVLLVFSHDYWSPEINQIIASVDFCQVLQIFFPFSIQLYPNEFPGHDPKDCPRDIKKKDAIELGCINAEYPDSFGHYREAKFSQTKHHWWWKLQFVWDKLKVLKEHHGLVLFIEEDHYLAPDFYYILNKMWQKKNEECSDCDMLCLGTYAQTPFADKAGKVEVKTWRSTEHNMGMAMTRETYKKLISCSETFCTYDDYNWDWTLQYLTVNCLPKFWKVMVPEVPRIYHIGDCGMHHNKPCRPTTESAKLEALFTSSQQELFPENIAISRRYTMAALSPHVKNGGWGDIRDHELCKSYHRLQ

SEQ ID NO: 43 - protein, 398 aa, Homo sapiens
  beta-1,4-galactosyltransferase 1
MRLREPLLSGSAAMPGASLQRACRLLVAVCALHLGVTLVYYLAGRDLSRLPQLVGVSTPLQGGSNSAAAIGQSSGELRTGGARPPPPLGASSQPRPGGDSSPVVDSGPGPASNLTSVPVPHTTALSLPACPEESPLLVGPMLIEFNMPVDLELVAKQNPNVKMGGRYAPRDCVSPHKVAIIIPFRNRQEHLKYWLYYLHPVLQRQQLDYGIYVINQAGDTIFNRAKLLNVGFQEALKDYDYTCFVFSDVDLIPMNDHNAYRCFSQPRHISVAMDKFGFSLPYVQYFGGVSALSKQQFLTINGFPNNYWGWGGEDDDIFNRLVFRGMSISRPNAVVGRCRMIRHSRDKKNEPNPQRFDRIAHTKETMLSDGLNSLTYQVLDVQRYPLYTQITVDIGTPS

SEQ ID NO: 44 - protein, 398 aa, Pan troglodytes
  beta-1,4-galactosyltransferase 1 isoform X1
MRLREPLLSGSAAMPGASLQRACRLLVAVCALHLGVTLVYYLAGRDLSRLPQLVGVSTALQGGSNGAAANGQSSGELRTGGARPPPPLGASSQPRPGGDSSPVVDSGPGPASNLTSVPVPHTTALSLPACPEESPLLVGPMLIEFNMPVDLELVAKQNPNVKMGGRYPPRDCLSPHNVAIIIPFRNRQEPLKYWLYYLHPVLQRQQVDYGIYVINQAGDTMFNRAKLLNVGFQEALKDYDYTCFVFSDVDLIPMNDHNAYRCFSQPRHISVAMDKFGFSLPYVQYFGGVSALSKQQFLTINGFPNNYWGWGGEDDDIFNRLVFRGMSISRPNAVVGRCRMIRHSRDKKNEPNPQRFDRIAHTKETMLSDGLNSLTYQVLDVQRYPLYTQITVDIGTPS

SEQ ID NO: 45 - protein, 398 aa, Macaca mulatta
  beta-1,4-galactosyltransferase 1
MRFREPLLGGSAAMPGASLQRACRLLVAVCALHLGVTLVYYLAGRDLSRLPQLVGVSTSLQGGSNGAAAIGQPSGELGTRGARPPPPLGASSQPRPAGDSSPVAASGPGPASNLTSVPVPQTTSLPLPACPEESPLLVGPMLIEFNMPVDLELVAKQNPNVKMGGRYTPRDCVSPHKVAIIIPFRNRQEHLKYWLYYLHPILQRQQLDYGIYVINQAGDTMFNRAKLLNVGFREALKDYDYTCFVFSDVDLIPMNDRNAYRCFSQPRHISVAMDKFGFSLPYVQYFGGVSALSKQQFLTINGFPNNYWGWGGEDDDIFNRLVFRGMSISRPNAVVGRCRMIRHSRDKKNEPNPQRFDRIAHTKETMLSDGLNSLTYQVLDVQRYPLYTQITVDIGTPS

SEQ ID NO: 46 - protein, 400 aa, Canis lupus familiaris
  beta-1,4-galactosyltransferase 1
  misc_feature (23)..(23): Xaa can be any naturally occurring amino acid
MRFREPLLGGSAAMPGASLQRAXSLLVAVCALHLGATLVYYLTGRDLSRLPQLVGVPTPLQGGSNGAAAIEQPSGELRPRGAPPLPPLDASSELRSGRDSSPGEDSGPRPGSASNLTSAPVPATTAPPLPACPEESPLLVGPMVIEFNMPVDLKLVEKQNPEVKVGGRYTPKNCISPHKVAIIIPFRNRQEHLKYWLYYLHPILQRQQLDYGIYVINQAGETMFNRAKLLNIGFQEALKDYDYNCFVFSDVDLIPMNDHNAYRCFSQPRHISVAMDKFGFSLPYVQYFGGVSALSKEQFLTINGFPNNYWGWGGEDDDIYNRLVFKGMSVSRPNAMVGKCRMIRHSRDKKNEPNPQRFDRIAHTKETMLSDGLNTLTYKVLDKERNPLYTKITVDIGTPS

SEQ ID NO: 47 - protein, 402 aa, Bos taurus
  beta-1,4-galactosyltransferase 1
MKFREPLLGGSAAMPGASLQRACRLLVAVCALHLGVTLVYYLAGRDLRRLPQLVGVHPPLQGSSHGAAAIGQPSGELRLRGVAPPPPLQNSSKPRSRAPSNLDAYSHPGPGPGPGSNLTSAPVPSTTTRSLTACPEESPLLVGPMLIEFNIPVDLKLIEQQNPKVKLGGRYTPMDCISPHKVAIIILFRNRQEHLKYWLYYLHPMVQRQQLDYGIYVINQAGESMFNRAKLLNVGFKEALKDYDYNCFVFSDVDLIPMNDHNTYRCFSQPRHISVAMDKFGFSLPYVQYFGGVSALSKQQFLSINGFPNNYWGWGGEDDDIYNRLAFRGMSVSRPNAVIGKCRMIRHSRDKKNEPNPQRFDRIAHTKETMLSDGLNSLTYMVLEVQRYPLYTKITVDIGTPS

SEQ ID NO: 48 - protein, 399 aa, Mus musculus
  beta-1,4-galactosyltransferase 1
MRFREQFLGGSAAMPGATLQRACRLLVAVCALHLGVTLVYYLSGRDLSRLPQLVGVSSTLQGGTNGAAASKQPPGEQRPRGARPPPPLGVSPKPRPGLDSSPGAASGPGLKSNLSSLPVPTTTGLLSLPACPEESPLLVGPMLIDFNIAVDLELLAKKNPEIKTGGRYSPKDCVSPHKVAIIIPFRNRQEHLKYWLYYLHPILQRQQLDYGIYVINQAGDTMFNRAKLLNIGFQEALKDYDYNCFVFSDVDLIPMDDRNAYRCFSQPRHISVAMDKFGFSLPYVQYFGGVSALSKQQFLAINGFPNNYWGWGGEDDDIFNRLVHKGMSISRPNAVVGRCRMIRHSRDKKNEPNPQRFDRIAHTKETMRFDGLNSLTYKVLDVQRYPLYTQITVDIGTPR

SEQ ID NO: 49 - protein, 399 aa, Rattus norvegicus
  beta-1,4-galactosyltransferase 1
MRFREPFLGGSAAMPGATLQRACRLLVAVCALHLGVTLVYYLSGRDLSRLPQLVGVSSSLQGGTNGAAASKQPSGELRPRGARPPPPLGVSPKPRPGSDSSPDAASGPGLKSNLTSVPMPTSTGLLTLPACPEESPLLVGPMVIDFNIPVDLELLAKKNPEIKMGGRYFPKDCISPHKVAIIIPFRNRQEHLKYWLYYLHPVLQRQQLDYGIYVINQAGDTMFNRAKLLNVGFQEALKDYDYNCFVFSDVDLIPMDDHNAYRCFSQPRHISVAMDKFGFSLPYVQYFGGVSALSKQQFLTINGFPNNYWGWGGEDDDIFNRLVHKGMSISRPNAVVGRCRMIRHSRDKKNEPNPQRFDRIAHTKETMRLDGLNSLTYQVLDIQRYPLYTKITVDIGTPR

SEQ ID NO: 50 - protein, 362 aa, Gallus gallu
  beta-1,4-galactosyltransferase 1
MKEPALPGTSLQRACRLLVAFCALHLSATLLYYLAGSSLTPPRSPEPPPRRPPPANLSLPPSRPPPPPAARPRPGPVSAQPRNLPDSAPSGLCPDPSPLLVGPLRVEFSQPVNLEEVASTNPEVREGGRFAPKDCKALQKVAIIIPFRNREEHLKYWLYYMHPILQRQQLDYGVYVINQDGDEEFNRAKLLNVGFTEALKEYDYDCFVFSDVDLIPMDDRNTYKCYSQPRHLSVSMDKFGFRLPYNQYFGGVSALSKEQFTKINGFPNNYWGWGGEDDDIYNRLVFKGMGISRPDAVIGKCRMIRHSRDRKNEPNPERFDRIAHTRETMSSDGLNSLSYEVLRTDRFPLYTRITVDIGAPGS

SEQ ID NO: 51 - protein, 350 aa, Danio rerio
  beta-1,4-galactosyltransferase 1
MPDSTGNFSLLQRTCSLVVLLCFLHIFVTVIYYMRNSDSRPAFAQNQQQRPTIHRKLAEQRGTTEDSRPAANASSNGQELQICPEEPPRLVGPLRVEFSDPITLEMVRTENSVLQEGGRFRPPDCIARQKVAMIIPFRNRDEHLKFWLYYLHPILQRQQLDYGVYVINQDGEDTFNRAKLLNIGYAEALKEYDYDCFVFSDVDLIPMDDRNIYKCYNQPRHLAVSMDKFGFRLPYTQYFGGVSSLSKEQFLKINGFPNNYWGWGGEDDDIFNRISSRGMSISRPDGLLGRCRMIRHERDKQNDPNPQRFDRIAHTRETMATDGINSLKYNVVKIEKDLLFTKITVDVGKP

SEQ ID NO: 52 - protein, 362 aa, Xenopus tropicalis
  beta-1,4-galactosyltransferase 1
MKEPQLPVSNLTAALPGASLQKACKFVVVFCSLHFCVVLIYYLSGADFGILQFFRQNQQSQLAYKQNYTISNATMRAISTKGRTKEPKEKLRNCPETSTLLVGPLQIVFSMHVDLEDIRKSNPDVIEGGHYRPKDCNALQKVAIIIPFRNRDEHLKYWLYYMHPILKRQQLDYGVYVINQDGDKTFNRAKLLNIGYVESLKDYAYDCFVFSDVDLIPMDDRNTYRCFNQPRHLSAAMDKFGFGLPYNQFFGGVSALSKEQFLKINGFPNNYWGWGGEDDDIYNRIASRGMYISRPDTLIGRCRMIRHNRDDKNDPNPKRFDLLAHTRQTMDSDGINTLSYKVVSTTRFPLYTYITVDIGLPH

SEQ ID NO: 53 - protein, 412 aa, Pasteurella multocida
  alpha-2,3/2,6-sialyltransferase/sialidase
MKNRRLNFKLFFLIIFSLFSTLSWSKTITLYLDPASLPALNQLMDFTQNNEDKTHPRIFGLSRFKIPDNIITQYQNIHFVELKDNRPTEALFTILDQYPGNIELNIHLNIAHSVQLIRPILAYRFKHLDRVSIQQLNLYDDGSMEYVDLEKEENKDISAEIKQAEKQLSHYLLTGKIKFDNPTIARYVWQSAFPVKYHFLSTDYFEKAEFLQPLKEYLAENYQKMDWTAYQQLTPEQQAFYLTLVGFNDEVKQSLEVQQAKFIFTGTTTWEGNTDVREYYAQQQLNLLNHFTQAEGDLFIGDHYKIYFKGHPRGGEINDYILNNAKNITNIPANISFEVLMMTGLLPDKVGGVASSLYFSLPKEKISHIIFTSNKQVKSKEDALNNPYVKVMRRLGIIDESQVIFWDSLKQL

SEQ ID NO: 54 - protein, 675 aa, Photobacterium damselae
  alpha-2,6-sialyltransferase
MKKILTVLSIFILSACNSDNTSLKETVSSNSADVVETETYQLTPIDAPSSFLSHSWEQTCGTPILNESDKQAISFDFVAPELKQDEKYCFTFKGITGDHRYITNTTLTVVAPTLEVYIDHASLPSLQQLIHIIQAKDEYPSNQRFVSWKRVTVDADNANKLNIHTYPLKGNNTSPEMVAAIDEYAQSKNRLNIEFYTNTAHVFNNLPPIIQPLYNNEKVKISHISLYDDGSSEYVSLYQWKDTPNKIETLEGEVSLLANYLAGTSPDAPKGMGNRYNWHKLYDTDYYFLREDYLDVEANLHDLRDYLGSSAKQMPWDEFAKLSDSQQTLFLDIVGFDKEQLQQQYSQSPLPNFIFTGTTTWAGGETKEYYAQQQVNVINNAINETSPYYLGKDYDLFFKGHPAGGVINDIILGSFPDMINIPAKISFEVLMMTDMLPDTVAGIASSLYFTIPADKVNFIVFTSSDTITDREEALKSPLVQVMLTLGIVKEKDVLFWADHKVNSMEVAIDEACTRIIAKRQPTASDLRLVIAIIKTITDLERIGDVAESIAKVALESFSNKQYNLLVSLESLGQHTVRMLHEVLDAFARMDVKAAIEVYQEDDRIDQEYESIVRQLMAHMMEDPSSIPNVMKVMWAARSIERVGDRCQNICEYIIYFVKGKDVRHTKPDDFGTMLD

SEQ ID NO: 55 - protein, 510 aa, Photobacterium damselae
  hypothetical alpha-2,6-sialyltransferase
MKKILTVLSIFILSACNSDNTSLKETVSSNSADVVETETYQLTPIDAPSSFLSHSWEQTCGTPILNESDKQAISFDFVAPELKQDEKYCFTFKGITGDHRYITNTTLTVVAPTLEVYIDHASLPSLQQLIHIIQAKDEYPSNQRFVSWKRVTVDADNANKLNIHTYPLKGNNTSPEMVAAIDEYAQSKNRLNIEFYTNTAHVFNNLPPIIQPLYNNEKVKISHISLYDDGSSEYVSLYQWKDTPNKIETLEGEVSLLANYLAGTSPDAPKGMGNRYNWHKLYDTDYYFLREDYLDVEANLHDLRDYLGSSAKQMPWDEFAKLSDSQQTLFLDIVGFDKEQLQQQYSQSPLPNFIFTGTTTWAGGETKEYYAQQQVNVINNAINETSPYYLGKDYDLFFKGHPAGGVINDIILGSFPDMINIPAKISFEVLMMTDMLPDTVAGIASSLYFTIPADKVNFIVFTSSDTITDREEALKSPLVQVMLTLGIVKEKDVLFWADLPDCSSGVCIDK

SEQ ID NO: 56 - protein, 497 aa, Photobacterium leiognathi
  alpha 2,6-sialyltransferase
MKRIFCLVSAILLSACNDNQNTVDVVVSTVNDNVIENNTYQVKPIDTPTTFDSYSWIQTCGTPILKDDEKYSLSFDFVAPELDQDEKFCFEFTGDVDGKRYVTQTNLTVVAPTLEVYVDHASLPSLQQLMKIIQQKNEYSQNERFISWGRIRLTEDNAEKLNAHIYPLAGNNTSQELVDAVIDYADSKNRLNLELNTNTGHSFRNIAPILRATSSKNNILISNINLYDDGSAEYVSLYNWKDTDNKSQKLSDSFLVLKDYLNGISSEKPNGIYSIYNWHQLYHSSYYFLRKDYLTVETKLHDLREYLGGSLKQMSWDTFSQLSKGDKELFLNIVGFDQEKLQQEYQQSELPNFVFTGTTTWAGGETKEYYAQQQVNVVNNAINETSPYYLGREHDLFFKGHPRGGIINDIILGSFNNMIDIPAKVSFEVLMMTGMLPDTVGGIASSLYFSIPAEKVSFIVFTSSDTITDREDALKSPLVQVMMTLGIVKEKDVLFWC

SEQ ID NO: 57 - protein, 511 aa, Photobacterium leiognathi
  alpha-2,6-sialyltransferase
MKRIFCLVSAILLSACNDNQNTVDVVVSTVNDNVIENNTYQVKPIDTPTTFDSYSWIQTCGTPILKDDEKYSLSFDFVAPELDQDEKFCFEFTGDVDGKRYVTQTNLTVVAPTLEVYVDHASLPSLQQLMKIIQQKNEYSQNERFISWGRIGLTEDNAEKLNAHIYPLAGNNTSQELVDAVIDYADSKNRLNLELNTNTAHSFPNLAPILRIISSKSNILISNINLYDDGSAEYVNLYNWKDTEDKSVKLSDSFLVLKDYFNGISSEKPSGIYGRYNWHQLYNTSYYFLRKDYLTVEPQLHDLREYLGGSLKQMSWDGFSQLSKGDKELFLNIVGFDQEKLQQEYQQSELPNFVFTGTTTWAGGETKEYYAQQQVNVVNNAINETSPYYLGREHDLFFKGHPRGGIINDIILGSFNNMIDIPAKVSFEVLMMTGMLPDTVGGIASSLYFSIPAEKVSFIVFTSSDTITDREDALKSPLVQVMMTLGIVKEKDVLFWSDLPDCSSGVCIAQY

SEQ ID NO: 58 - protein, 514 aa, Photobacterium sp. JT-ISH-224
  beta-galactoside alpha-2,6-sialyltransferase
MKNFLLLTLILLTACNNSEENTQSIIKNDINKTIIDEEYVNLEPINQSNISFTKHSWVQTCGTQQLLTEQNKESISLSVVAPRLDDDEKYCFDFNGVSNKGEKYITKVTLNVVAPSLEVYVDHASLPTLQQLMDIIKSEEENPTAQRYIAWGRIVPTDEQMKELNITSFALINNHTPADLVQEIVKQAQTKHRLNVKLSSNTAHSFDNLVPILKELNSFNNVTVTNIDLYDDGSAEYVNLYNWRDTLNKTDNLKIGKDYLEDVINGINEDTSNTGTSSVYNWQKLYPANYHFLRKDYLTLEPSLHELRDYIGDSLKQMQWDGFKKFNSKQQELFLSIVNFDKQKLQNEYNSSNLPNFVFTGTTVWAGNHEREYYAKQQINVINNAINESSPHYLGNSYDLFFKGHPGGGIINTLIMQNYPSMVDIPSKISFEVLMMTDMLPDAVAGIASSLYFTIPAEKIKFIVFTSTETITDRETALRSPLVQVMIKLGIVKEENVLFWADLPNCETGVCIAV

SEQ ID NO: 59 - DNA, 8001 bp, Artificial Sequence
  pLMTB4239 ssu::LMSAP1-rhEPO Strep; sat marker (nourseothricin resistance)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctgccatggcctcgaggctcgtccgtgtgctggccgccgccatgctggttgcagcggccgtgtcggtcgacgcggcgccgccacgcctgatctgcgacagccgcgtgctggagcgctacctgctggaggcgaaggaagcggagaacatcaccaccggctgcgcggagcactgcagcctgaacgagaacatcacggtgccggacacgaaggtgaacttctacgcgtggaagcgcatggaggtcggccagcaggcggtggaggtctggcagggcctggcgctgctgagcgaggcggtgctgcgcggccaggccctgctggtgaacagcagccagccgtgggagccgctgcagctgcacgtggacaaggccgtgagcggcctgcgcagcctgaccaccctgctgcgcgccctgggcgcccagaaggaagcgatcagcccgccggacgccgccagcgccgccccgctgcgcacgatcacggccgacacgttccgcaagctgttccgcgtgtacagcaacttcctgcgcggcaagctgaagctgtacaccggcgaggcctgccgcaccggcgacgcgggagcgtggtcccacccgcagttcgagaagtaatctagccttaagggtacccaccaccatcaccaccactaggcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatcctagtatgaagatttcggtgatccctgagcaggtggcggaaacattggatgctgagaaccatttcattgttcgtgaagtgttcgatgtgcacctatccgaccaaggctttgaactatctaccagaagtgtgagcccctaccggaaggattacatctcggatgatgactctgatgaagactctgcttgctatggcgcattcatcgaccaagagcttgtcgggaagattgaactcaactcaacatggaacgatctagcctctatcgaacacattgttgtgtcgcacacgcaccgaggcaaaggagtcgcgcacagtctcatcgaatttgcgaaaaagtgggcactaagcagacagctccttggcatacgattagagacacaaacgaacaatgtacctgcctgcaatttgtacgcaaaatgtggctttactctcggcggcattgacctgttcacgtataaaactagacctcaagtctcgaacgaaacagcgatgtactggtactggttctcgggagcacaggatgacgcctaactagcctcggagatccactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 60 - DNA, 9337 bp, Artificial Sequence
  pLMTB5825 ssu::90MG1-SFGNT-I-3HA-Strep; hyg marker (hygromycin resistance)
gatctatgctgaagaagcagagcgcgggcctggtgctgtggggcgcgatcctgttcgtggcgtggaacgcgctgctgctgctgttcttctggacgcgcccggcgccgggccgcccgccgagcgtgagcgcgctggacggcgacccggcgagcctgacgcgcgaggtgatccgcctggcgcaggacgcggaggtggagctggagcgccagcgcggcctgctgcagcagatcggcgacgcgctgagcagccagcgcggccgcgtgccgacggcggcggaggtgatgcagcacctgagccagccgatcctgccggtgctggtgatcgcgtgcgaccgcgtgacggtgcagcgctgcctggacaacctggtgaagttccgcccgagcaaggagacgttcccgatcatcgtgagccaggactgcggccacaacgcgacgtacgaggtgatcacgagctacacggcgagcgacccgacgatcagcgtggtgcgccagccggacctgagcgagatcgtgctgccgcgcgtgaaggtgaagttccgcggctactacaagatcgcgcgccactacaagttcgcgctgaaccacgtgttcgagacgctgggccacgaggcggtgatcatcgtggaggacgacctggacatcagcccggacttcttcgagtacttcctgggcacgtacccgctgctgctgaaggacccgagcctgtggtgcatcagcgcgtggaacgacaacggcaagatggaggtgatcgacatgagccgcccggacctgctgcaccgcacggacttcttcccgggcctgggctgggtgctgcgccgcgagatgtggcgcaagctggcgccgaagtggccgacggcgttcttcgacgactggctgcgcaacccggtgaacatcgacggcaaggcgtgcatccgcccggagatcagccgcacgtacagcttcggcaaggtgggcgtgagcaagggcctgttcttcgacctgcacctgcgcaacatccagctgaacatggagtacgtggagttcacgaagctgaacctgacgtacctgctgaaggagcactacgacgacgcgctggtgagcacggtgtacaacctgccggagatgagcgcgagcgaggtggtggcgggcagcgacctgagcgcggacccggtgcgcgtgatgtacagcaacgcgaagacgtaccagcgcgcggcgaagaagctgggcctgatggacgacttccgcagcggcgtgccgcgcacggcgtaccgcggcatcgtgacgtgcttcatccgcggccgccgcgtgtacctggcgccgagcttcgagtggaacaagtacgacccgacgtggggcgcgggcgcgtacccgtacgacgtgccggactacgcgtacccgtacgacgtgccggactacgcgtacccgtacgacgtgccggactacgcggcgggcgcgtggagccacccgcagttcgagaagtgagctagccttaagggtacccaccaccatcaccaccactaggcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccacca

SEQ ID NO: 61 - DNA, 9337 bp, Artificial Sequence
  pLMTB5826 ssu::110MG1-SFGNT-I-3HA-Strep; hyg marker (hygromycin resistance)
gatctatgctgaagaagcagagcgcgggcctggtgctgtggggcgcgatcctgttcgtggcgtggaacgcgctgctgctgctgttcttctggacgcgcccggcgccgggccgcccgccgagcgtgagcgcgctggacggcgacccggcgagcctgacgcgcgaggtgatccgcctggcgcaggacgcggaggtggagctggagcgccagcgcggcctgctgcagcagatcggcgacgcgctgagcagccagcgcggccgcgtgccgacggcggcgccgccggcgcagccgcgcgtgccggtgacgccggcgccggcggtgatcccgatcctggtggtgacggtgcagcgctgcctggacaacctggtgaagttccgcccgagcaaggagacgttcccgatcatcgtgagccaggactgcggccacaacgcgacgtacgaggtgatcacgagctacacggcgagcgacccgacgatcagcgtggtgcgccagccggacctgagcgagatcgtgctgccgcgcgtgaaggtgaagttccgcggctactacaagatcgcgcgccactacaagttcgcgctgaaccacgtgttcgagacgctgggccacgaggcggtgatcatcgtggaggacgacctggacatcagcccggacttcttcgagtacttcctgggcacgtacccgctgctgctgaaggacccgagcctgtggtgcatcagcgcgtggaacgacaacggcaagatggaggtgatcgacatgagccgcccggacctgctgcaccgcacggacttcttcccgggcctgggctgggtgctgcgccgcgagatgtggcgcaagctggcgccgaagtggccgacggcgttcttcgacgactggctgcgcaacccggtgaacatcgacggcaaggcgtgcatccgcccggagatcagccgcacgtacagcttcggcaaggtgggcgtgagcaagggcctgttcttcgacctgcacctgcgcaacatccagctgaacatggagtacgtggagttcacgaagctgaacctgacgtacctgctgaaggagcactacgacgacgcgctggtgagcacggtgtacaacctgccggagatgagcgcgagcgaggtggtggcgggcagcgacctgagcgcggacccggtgcgcgtgatgtacagcaacgcgaagacgtaccagcgcgcggcgaagaagctgggcctgatggacgacttccgcagcggcgtgccgcgcacggcgtaccgcggcatcgtgacgtgcttcatccgcggccgccgcgtgtacctggcgccgagcttcgagtggaacaagtacgacccgacgtggggcgcgggcgcgtacccgtacgacgtgccggactacgcgtacccgtacgacgtgccggactacgcgtacccgtacgacgtgccggactacgcggcgggcgcgtggagccacccgcagttcgagaagtgagctagccttaagggtacccaccaccatcaccaccactaggcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccacca

SEQ ID NO: 62 - DNA, 9337 bp, Artificial Sequence
  pLMTB5827 ssu::130MG1-SFGNT-I-3HA-Strep; hyg marker (hygromycin resistance)
gatctatgctgaagaagcagagcgcgggcctggtgctgtggggcgcgatcctgttcgtggcgtggaacgcgctgctgctgctgttcttctggacgcgcccggcgccgggccgcccgccgagcgtgagcgcgctggacggcgacccggcgagcctgacgcgcgaggtgatccgcctggcgcaggacgcggaggtggagctggagcgccagcgcggcctgctgcagcagatcggcgacgcgctgagcagccagcgcggccgcgtgccgacggcggcgccgccggcgcagccgcgcgtgccggtgacgccggcgccggcggtgatcccgatcctggtgatcgcgtgcgaccgcagcacggtgcgccgctgcctggacaagctgctgcactaccgcccgccgatcatcgtgagccaggactgcggccacaacgcgacgtacgaggtgatcacgagctacacggcgagcgacccgacgatcagcgtggtgcgccagccggacctgagcgagatcgtgctgccgcgcgtgaaggtgaagttccgcggctactacaagatcgcgcgccactacaagttcgcgctgaaccacgtgttcgagacgctgggccacgaggcggtgatcatcgtggaggacgacctggacatcagcccggacttcttcgagtacttcctgggcacgtacccgctgctgctgaaggacccgagcctgtggtgcatcagcgcgtggaacgacaacggcaagatggaggtgatcgacatgagccgcccggacctgctgcaccgcacggacttcttcccgggcctgggctgggtgctgcgccgcgagatgtggcgcaagctggcgccgaagtggccgacggcgttcttcgacgactggctgcgcaacccggtgaacatcgacggcaaggcgtgcatccgcccggagatcagccgcacgtacagcttcggcaaggtgggcgtgagcaagggcctgttcttcgacctgcacctgcgcaacatccagctgaacatggagtacgtggagttcacgaagctgaacctgacgtacctgctgaaggagcactacgacgacgcgctggtgagcacggtgtacaacctgccggagatgagcgcgagcgaggtggtggcgggcagcgacctgagcgcggacccggtgcgcgtgatgtacagcaacgcgaagacgtaccagcgcgcggcgaagaagctgggcctgatggacgacttccgcagcggcgtgccgcgcacggcgtaccgcggcatcgtgacgtgcttcatccgcggccgccgcgtgtacctggcgccgagcttcgagtggaacaagtacgacccgacgtggggcgcgggcgcgtacccgtacgacgtgccggactacgcgtacccgtacgacgtgccggactacgcgtacccgtacgacgtgccggactacgcggcgggcgcgtggagccacccgcagttcgagaagtgagctagccttaagggtacccaccaccatcaccaccactaggcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccacca

SEQ ID NO: 63 - DNA, 9337 bp, Artificial Sequence
  pLMTB5828 ssu::150MG1-SFGNT-I-3HA-Strep; hyg marker (hygromycin resistance)
gatctatgctgaagaagcagagcgcgggcctggtgctgtggggcgcgatcctgttcgtggcgtggaacgcgctgctgctgctgttcttctggacgcgcccggcgccgggccgcccgccgagcgtgagcgcgctggacggcgacccggcgagcctgacgcgcgaggtgatccgcctggcgcaggacgcggaggtggagctggagcgccagcgcggcctgctgcagcagatcggcgacgcgctgagcagccagcgcggccgcgtgccgacggcggcgccgccggcgcagccgcgcgtgccggtgacgccggcgccggcggtgatcccgatcctggtgatcgcgtgcgaccgcagcacggtgcgccgctgcctggacaagctgctgcactaccgcccgagcgcggagctgttcccgatcatcgtgagccaggactgcggccacgaggagacggcgcagacggcgagcgacccgacgatcagcgtggtgcgccagccggacctgagcgagatcgtgctgccgcgcgtgaaggtgaagttccgcggctactacaagatcgcgcgccactacaagttcgcgctgaaccacgtgttcgagacgctgggccacgaggcggtgatcatcgtggaggacgacctggacatcagcccggacttcttcgagtacttcctgggcacgtacccgctgctgctgaaggacccgagcctgtggtgcatcagcgcgtggaacgacaacggcaagatggaggtgatcgacatgagccgcccggacctgctgcaccgcacggacttcttcccgggcctgggctgggtgctgcgccgcgagatgtggcgcaagctggcgccgaagtggccgacggcgttcttcgacgactggctgcgcaacccggtgaacatcgacggcaaggcgtgcatccgcccggagatcagccgcacgtacagcttcggcaaggtgggcgtgagcaagggcctgttcttcgacctgcacctgcgcaacatccagctgaacatggagtacgtggagttcacgaagctgaacctgacgtacctgctgaaggagcactacgacgacgcgctggtgagcacggtgtacaacctgccggagatgagcgcgagcgaggtggtggcgggcagcgacctgagcgcggacccggtgcgcgtgatgtacagcaacgcgaagacgtaccagcgcgcggcgaagaagctgggcctgatggacgacttccgcagcggcgtgccgcgcacggcgtaccgcggcatcgtgacgtgcttcatccgcggccgccgcgtgtacctggcgccgagcttcgagtggaacaagtacgacccgacgtggggcgcgggcgcgtacccgtacgacgtgccggactacgcgtacccgtacgacgtgccggactacgcgtacccgtacgacgtgccggactacgcggcgggcgcgtggagccacccgcagttcgagaagtgagctagccttaagggtacccaccaccatcaccaccactaggcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccacca

SEQ ID NO: 64 - DNA, 9337 bp, Artificial Sequence
  pLMTB5829 ssu::SFGNT-I-3xHA-Strep native; hyg marker (hygromycin resistance)
gatctatgcgcctgaacgtgaagaaggcgctgatcttcgtgggctgcgtggtgttcctgtgggtgctgctgagctacgcgagcgtgatcgaggtgccgcgcgcggtgccgcagaaggacccggcggtggagatcgagaagaagatcatcaagctgcagaagcaggtggacgcgcagatggcggagagcaagagcctgctggcgaaggtgaagaagctgaagaagatcagcgagggcgagaacgtgggcggcgaggaggacagcctgaaggacagcgaggtgatgcagcacctgagccagccgatcctgccggtgctggtgatcgcgtgcgaccgcgtgacggtgcagcgctgcctggacaacctggtgaagttccgcccgagcaaggagacgttcccgatcatcgtgagccaggactgcggccacaacgcgacgtacgaggtgatcacgagctacacggcgagcgacccgacgatcagcgtggtgcgccagccggacctgagcgagatcgtgctgccgcgcgtgaaggtgaagttccgcggctactacaagatcgcgcgccactacaagttcgcgctgaaccacgtgttcgagacgctgggccacgaggcggtgatcatcgtggaggacgacctggacatcagcccggacttcttcgagtacttcctgggcacgtacccgctgctgctgaaggacccgagcctgtggtgcatcagcgcgtggaacgacaacggcaagatggaggtgatcgacatgagccgcccggacctgctgcaccgcacggacttcttcccgggcctgggctgggtgctgcgccgcgagatgtggcgcaagctggcgccgaagtggccgacggcgttcttcgacgactggctgcgcaacccggtgaacatcgacggcaaggcgtgcatccgcccggagatcagccgcacgtacagcttcggcaaggtgggcgtgagcaagggcctgttcttcgacctgcacctgcgcaacatccagctgaacatggagtacgtggagttcacgaagctgaacctgacgtacctgctgaaggagcactacgacgacgcgctggtgagcacggtgtacaacctgccggagatgagcgcgagcgaggtggtggcgggcagcgacctgagcgcggacccggtgcgcgtgatgtacagcaacgcgaagacgtaccagcgcgcggcgaagaagctgggcctgatggacgacttccgcagcggcgtgccgcgcacggcgtaccgcggcatcgtgacgtgcttcatccgtggtcgtcgcgtgtacctggcgccgagcttcgagtggaacaagtacgacccgacgtggggcgcgggcgcgtacccgtacgacgtgccggactacgcgtacccgtacgacgtgccggactacgcgtacccgtacgacgtgccggactacgcggcgggcgcgtggagccacccgcagttcgagaagtgagctagccttaagggtacccaccaccatcaccaccactaggcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccacca

SEQ ID NO: 65 - DNA, 10282 bp, Artificial Sequence
  pLMTB5830 ssu::MGAT2-Strep-SFGNT1-3xHA; hyg marker (hygromycin resistance)
gatctatgcgcttccgcatctacaagcgcaaggtgctgatcctgacgctggtggtggcggcgtgcggcttcgtgctgtggagcagcaacggccgccagcgcaagaacgacgcgctggcgccgccgctgctggacagcgagccgctgcgcggcgcgggccacttcgcggcgagcgtgggcatccgccgcgtgagcaacgacagcgcggcgccgctggtgccggcggtgccgcgcccggaggtggacaacctgacgctgcgctaccgcagcctggtgtaccagctgaacttcgaccagatgctgcgcaacgtggacaaggacggcacgtggagcccgggcgagctggtgctggtggtgcaggtgcacaaccgcccggagtacctgcgcctgctgatcgacagcctgcgcaaggcgcagggcatccgcgaggtgctggtgatcttcagccacgacttctggagcgcggagatcaacagcctgatcagcagcgtggacttctgcccggtgctgcaggtgttcttcccgttcagcatccagctgtacccgagcgagttcccgggcagcgacccgcgcgactgcccgcgcgacctgaagaagaacgcggcgctgaagctgggctgcatcaacgcggagtacccggacagcttcggccactaccgcgaggcgaagttcagccagacgaagcaccactggtggtggaagctgcacttcgtgtgggagcgcgtgaaggtgctgcaggactacacgggcctgatcctgttcctggaggaggaccactacctggcgccggacttctaccacgtgttcaagaagatgtggaagctgaagcagcaggagtgcccgggctgcgacgtgctgagcctgggcacgtacacgacgatccgcagcttctacggcatcgcggacaaggtggacgtgaagacgtggaagagcacggagcacaacatgggcctggcgctgacgcgcgacgcgtaccagaagctgatcgagtgcacggacacgttctgcacgtacgacgactacaactgggactggacgctgcagtacctgacgctggcgtgcctgccgaaggtgtggaaggtgctggtgccgcaggcgccgcgcatcttccacgcgggcgactgcggcatgcaccacaagaagacgtgccgcccgagcacgcagagcgcgcagatcgagagcctgctgaacaacaacaagcagtacctgttcccggagacgctggtgatcggcgagaagttcccgatggcggcgatcagcccgccgcgcaagaacggcggctggggcgacatccgcgaccacgagctgtgcaagagctaccgccgcctgcaggcgggcgcgtggagccacccgcagttcgagaaggcgggcgcgccgatcatcgtgagccaggactgcggccacaacgcgacgtacgaggtgatcacgagctacacggcgagcgacccgacgatcagcgtggtgcgccagccggacctgagcgagatcgtgctgccgcgcgtgaaggtgaagttccgcggctactacaagatcgcgcgccactacaagttcgcgctgaaccacgtgttcgagacgctgggccacgaggcggtgatcatcgtggaggacgacctggacatcagcccggacttcttcgagtacttcctgggcacgtacccgctgctgctgaaggacccgagcctgtggtgcatcagcgcgtggaacgacaacggcaagatggaggtgatcgacatgagccgcccggacctgctgcaccgcacggacttcttcccgggcctgggctgggtgctgcgccgcgagatgtggcgcaagctggcgccgaagtggccgacggcgttcttcgacgactggctgcgcaacccggtgaacatcgacggcaaggcgtgcatccgcccggagatcagccgcacgtacagcttcggcaaggtgggcgtgagcaagggcctgttcttcgacctgcacctgcgcaacatccagctgaacatggagtacgtggagttcacgaagctgaacctgacgtacctgctgaaggagcactacgacgacgcgctggtgagcacggtgtacaacctgccggagatgagcgcgagcgaggtggtggcgggcagcgacctgagcgcggacccggtgcgcgtgatgtacagcaacgcgaagacgtaccagcgcgcggcgaagaagctgggcctgatggacgacttccgcagcggcgtgccgcgcacggcgtaccgcggcatcgtgacgtgcttcatccgtggtcgtcgcgtgtacctggcgccgagcttcgagtggaacaagtacgacccgacgtggggcgcgggcgcgtacccgtacgacgtgccggactacgcgtacccgtacgacgtgccggactacgcgtacccgtacgacgtgccggactacgcgtgagctagccttaagggtacccaccaccatcaccaccactaggcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccacca

SEQ ID NO: 66 - DNA, 10372 bp, Artificial Sequence
  pLMTB5831 ssu::MGAT2-Strep-MGhybrSFGNT1-3xHA; hyg marker (hygromycin resistance)
gatctatgcgcttccgcatctacaagcgcaaggtgctgatcctgacgctggtggtggcggcgtgcggcttcgtgctgtggagcagcaacggccgccagcgcaagaacgacgcgctggcgccgccgctgctggacagcgagccactgcgcggtgcgggtcacttcgcggcgagcgtgggcatccgccgcgtgagcaacgacagcgcagcaccgctggtgccggcagtgccacgcccagaggtggacaacctgacgctgcgctaccgcagcctggtgtaccagctgaacttcgaccagatgctgcgcaacgtggacaaggacggcacgtggagcccgggcgagctggtgctggtggtgcaggtgcacaaccgcccagagtacctgcgcctgctgatcgacagcctgcgcaaggcgcagggcatccgcgaggtgctggtgatcttcagccacgacttctggagcgcggagatcaacagcctgatcagcagcgtggacttctgcccggtgctgcaggtgttcttcccgttcagcatccagctgtacccgagcgagttcccaggaagcgacccgcgcgactgcccgcgcgacctgaagaagaacgcggcgctgaagctgggctgcatcaacgcggagtacccggacagcttcggccactaccgcgaggcgaagttcagccagacgaagcaccactggtggtggaagctgcacttcgtgtgggagcgcgtgaaggtgctgcaggactacacgggcctgatcctgttcctggaggaggaccactacctggcgccggacttctaccacgtgttcaagaagatgtggaagctgaagcagcaggagtgcccgggctgcgacgtgctgagcctgggcacgtacacgacgatccgcagcttctacggcatcgcggacaaggtggacgtgaagacgtggaagagcacggagcacaacatgggcctggcgctgacgcgcgacgcgtaccagaagctgatcgagtgcacggacacgttctgcacgtacgacgactacaactgggactggacgctgcagtacctgacgctggcgtgcctgccgaaggtgtggaaggtgctggtgccgcaggcgccgcgcatcttccacgcgggcgactgcggcatgcaccacaagaagacgtgccgcccgagcacgcagagcgcgcagatcgagagcctgctgaacaacaacaagcagtacctgttcccggagacgctggtgatcggcgagaagttcccgatggcggcgatcagcccaccgcgcaagaacggtggctggggtgacatccgcgaccacgagctgtgcaagagctaccgccgcctgcaggcaggtgcgtggagccacccgcagttcgagaaggcaggtgcaccggcaccggcggtgatcccgatcctggtgatcgcgtgcgaccgcagcacggtgcgccgctgcctggacaagctgctgcactaccgcccgagcgcggagctgttcccgatcatcgtgagccaggactgcggccacgaggagacggcgcagacggcgagcgacccgacgatcagcgtggtgcgccagccggacctgagcgagatcgtgctgccacgcgtgaaggtgaagttccgcggctactacaagatcgcgcgccactacaagttcgcactgaaccacgtgttcgagacgctgggccacgaggcggtgatcatcgtggaggacgacctggacatcagcccggacttcttcgaatacttcctgggcacgtacccgctgctgctgaaggacccgagcctgtggtgcatcagcgcgtggaacgacaacggcaagatggaggtgatcgacatgagccgcccggacctgctgcaccgcacggacttcttcccaggcctgggctgggtgctgcgccgcgagatgtggcgcaagctggcgccgaagtggccgacggcgttcttcgacgactggctgcgcaacccggtgaacatcgacggcaaggcgtgcatccgcccagagatcagccgcacgtacagcttcggcaaggtgggcgtgagcaagggcctgttcttcgacctgcacctgcgcaacatccagctgaacatggagtacgtggagttcacgaagctgaacctgacgtacctgctgaaggagcactacgacgacgcgctggtgagcacggtgtacaacctgccggagatgagcgcgagcgaggtggtggcgggcagcgacctgagcgcagacccggtgcgcgtgatgtacagcaacgcgaagacgtaccagcgcgcggcgaagaagctgggcctgatggacgacttccgcagcggtgtgccacgcacggcgtaccgcggcatcgtgacgtgcttcatccgcggtcgccgcgtgtacctggcgccgagcttcgagtggaacaagtacgacccgacgtggggtgcgggagcgtacccgtacgacgtgccggactacgcgtacccgtacgacgtgccggactacgcgtacccgtacgacgtgccggactacgcgtgagctagccttaagggtacccaccaccatcaccaccactaggcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccacca

SEQ ID NO: 67 - DNA, 9097 bp, Artificial Sequence
  pLMTB5843 ssu::mST3GAL3-3HA; hyg marker (hygromycin resistance)
gatctatgggcctgctggtgttcgtgcgcaacctgctgctggcgctgtgcctgttcctggtgctgggcttcctgtactacagcgcgtggaagctgcacctgctgcagtgggaggacagcaacagcctgctgctgagcctggacagcgcgggccagacgctgggcacggagtacgaccgcctgggcttcctgctgaagctggacagcaagctgccggcggagctggcgacgaagtacgcgaacttcagcgaaggtgcgtgcaaaccaggttacgcgagcgcgatgatgacggcgatcttcccacgcttcagtaagccagcaccaatgttcctggacgacagcttccgcaagtgggcgcgcatccgcgagtttgtgccaccgttcggcatcaagggccaggacaacctgatcaaggcaatcctgagcgtgacgaaggagtaccgcctgacgccagcactggacagcctgcactgccgccgttgcatcatcgtgggcaacggcggcgtgctggcgaacaagagcttgggtagccgcatcgacgactacgacatcgtgatccgcctgaacagcgcgccagtgaagggcttcgagcgcgacgtgggcagcaagacgacgctgcgcatcacgtacccggagggtgcaatgcagcgcccggagcagtacgagcgcgacagcctgttcgtgctggcgggcttcaagtggcaggacttcaagtggctgaagtacatcgtgtacaaggagcgcgtgagcgcaagcgacggcttctggaagagcgtggcgacacgcgtgccgaaggagccaccggagatccgcatcctgaacccgtacttcatccaggaggcggcgttcacgctgatcggcctgccgttcaacaacggcctgatgggccgcggcaacatcccgacgctgggcagcgtggcggtgacgatggcgctgcacggctgcgacgaggtggcagtggcaggtttcggctacgacatgaacacgccgaacgcgccgctgcactactacgagacggtgcgcatggcggcgatcaaggagagctggacgcacaacatccagcgcgagaaggagttcctgcgtaagctggtgaaggcgcgcgtgatcacggacctgagtagtggcatcgcaggtgcttacccgtacgacgtgccggactacgcgtacccgtacgacgtgccggactacgcgtacccgtacgacgtgccggactacgcgtaagctagccttaagggtacccaccaccatcaccaccactaggcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccacca

SEQ ID NO: 68 - DNA, 9184 bp, Artificial Sequence
  pLMTB5845 ssu::mST6GAL1-3HA; hyg marker (hygromycin resistance)
gatctatgatccacacgaacctgaagcgcaagttcagctgcttcgtgctggtgttcctgctgttcgcgatcatctgcgtgtggaagaagggcagcgactacgaggcgctgacgctgcaggcgaaggtgttccagatgccgaagagccaggagaaggtggcagtgggtccagcgccacaggctgtgttcagcaacagcaagcaggacccgaaggagggcgtgcagatcctgagctacccgcgcgtgacggcgaaggtgaagccgcagccgagcctgcaggtgtgggacaaggacagcacgtacagcaagctgaacccgcgcctgctgaagatttggcgcaactacctgaacatgaacaagtacaaggtgagctacaagggcccgggcccgggcgtgaagttcagcgtggaggcgctgcgctgccacctgcgcgaccacgtgaacgtgagcatgatcgaggcgacggacttcccgttcaacacgacggagtgggagggttacctgccgaaggagaacttccgcacgaaggctggtccgtggcacaagtgcgcggtggtgagcagcgcgggcagcctgaagaacagccagctgggccgcgagatcgacaaccacgacgcggtgctgcgcttcaacggcgctccgacggacaacttccagcaggacgtgggcacgaagacgacgatccgcctggtgaacagccagctggtgacgacggagaagcgcttcctgaaggacagcctgtacacggagggtatcctgatcctgtgggatccgagcgtgtaccacgcggacatcccgcagtggtaccagaagccggactacaacttcttcgagacgtacaagagctaccgccgcctgcacccgagccagccgttctacatcctgaagccgcagatgccatgggagctgtgggacatcatccaggagatcagcccggacctgatccagccgaacccgccgagcagcggcatgctgggcatcatcatcatgatgacgctgtgcgaccaggtggacatctacgagttcctgccgagcaagcgcaagacggacgtgtgctactaccaccagaagttcttcgacagcgcgtgcacgatgggcgcgtaccacccgctgctgttcgagaagaacatggtgaagcacctgaacgagggcacggacgaggacatctacctgttcggcaaggcgacgctgagcggcttccgcaacaaccgctgcgcaggtgcttacccgtacgacgtgccggactacgcgtacccgtacgacgtgccggactacgcgtacccgtacgacgtgccggactacgcgtaagctagccttaagggtacccaccaccatcaccaccactaggcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccacca

SEQ ID NO: 69 - DNA, 9184 bp, Artificial Sequence
  pLMTB5847 ssu::rST6GAL1-3HA; hyg marker (hygromycin resistance)
gatctatgatccacacgaacctgaagaagaagttcagcctgttcatcctggtgttcctgctgttcgcggtgatctgcgtgtggaagaagggcagcgactacgaggcgctgacgctgcaggcgaaggagttccagatgccgaagagccaggagaaggtggcgatgggcagcgcgagccaggtggtgttcagcaacagcaagcaggacccgaaggaggacatcccgatcctgagctaccaccgcgtgacggcgaaggtgaagccgcagccgagcttccaggtgtgggacaaggacagcacgtacagcaagctgaacccgcgcctgctgaagatttggcgcaactacctgaacatgaacaagtacaaggtgagctacaagggtccaggtccgggcgtgaagttcagcgtggaggcactgcgctgccacctgcgcgaccacgtgaacgtgagcatgatcgaggcgacggacttcccgttcaacacgacggagtgggagggctacctgccgaaggagaacttccgcacgaaggtgggcccgtggcagcgctgcgcagtggtgagcagcgcaggtagcctgaagaacagccagctgggtcgcgagatcgacaaccacgacgcggtgctgcgcttcaacggcgcgccgacggacaacttccagcaggacgtgggcagcaagacgacgatccgcctgatgaacagccagctggtgacgacggagaagcgcttcctgaaggacagcctgtacacggagggcatcctgatcgtgtgggatccaagcgtgtaccacgcggacatcccgaagtggtaccagaagccggactacaacttcttcgagacgtacaagagctaccgccgcctgaacccgagccagccgttctacatcctgaagccgcagatgccgtgggagctgtgggacatcatccaggagatcagcgcggacctgatccagccgaacccaccgagcagcggcatgctgggcatcatcatcatgatgacgctgtgcgaccaggtggacatctacgagttcctgccgagcaagcgcaagacggacgtgtgctactaccaccagaagttcttcgacagcgcgtgcacgatgggtgcgtaccacccgctgctgttcgagaagaacatggtgaagcacctgaacgagggcacggacgaggacatctacctgttcggcaaggcgacgctgagcggcttccgcaacatccgctgcgcaggtgcttacccgtacgacgtgccggactacgcgtacccgtacgacgtgccggactacgcgtacccgtacgacgtgccggactacgcgtaagctagccttaagggtacccaccaccatcaccaccactaggcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccacca

SEQ ID NO: 70 - DNA, 8959 bp, Artificial Sequence
  pLMTB5849 ssu::hST3GAL4-3HA; hyg marker (hygromycin resistance)
gatctatggtgagcaagagccgctggaagctgctggcgatgctggcgctggtgctggtggtgatggtgtggtacagcatcagccgcgaggacagcttctacttcccgatcccggagaagaaggagccgtgcctgcagggcgaggcggagagcaaggcgagcaagctgttcggcaactacagccgcgaccagccgatcttcctgcgcctggaggactacttctgggtgaagacgccgagcgcgtacgagctgccgtacggcacgaagggcagcgaggacctgctgctgcgcgtgctggcgatcacgagcagcagcatcccgaagaacatccagagcctgcgctgtcgccgctgcgtggtggtgggtaacggccaccgcctgcgcaacagcagcctgggcgacgcgatcaacaagtacgacgtggtgatccgcctgaacaacgcaccagtggcaggctacgagggcgacgtgggcagcaagacgacgatgcgcctgttctacccggagagcgcgcacttcgacccgaaggtggagaacaacccggacacgctgctggtgctggtggcgttcaaggcgatggacttccactggatcgagacgatcctgagcgacaagaagcgcgtgcgcaagggcttctggaagcagccgccgctgatctgggacgtgaacccgaagcagatccgcatcctgaacccgttcttcatggagatcgcggcagacaagctgctgagcctgccgatgcagcagccgcgcaagatcaagcagaagccgacgacgggcctgctggcgatcacgctggcgctgcacctgtgcgacctggtgcacatcgcaggcttcggctacccggacgcgtacaacaagaagcagacgatccactactacgagcagatcacgctgaagagcatggcgggcagcggccacaacgtgagccaggaggcgctggcgatcaagcgcatgctggagatgggcgcgatcaagaacctgacgagcgcaggtgcttacccgtacgacgtgccggactacgcgtacccgtacgacgtgccggactacgcgtacccgtacgacgtgccggactacgcgtaagctagccttaagggtacccaccaccatcaccaccactaggcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccacca

SEQ ID NO: 71 - DNA, 9193 bp, Artificial Sequence
  pLMTB5851 ssu::hST6GAL1-3HA; hyg marker (hygromycin resistance)
gatctatgatccacacgaacctgaagaagaagttcagctgctgcgtgctggtgttcctgctgttcgcggtgatctgcgtgtggaaggagaagaagaagggcagctactacgacagcttcaagctgcagacgaaggagttccaggtgctgaagagcctgggcaagctggcgatgggcagcgacagccagagcgtgagcagcagcagcacgcaggacccgcaccgcggtcgccagacgctgggcagcctgcgcggtctggcgaaggcgaagccggaggcgagcttccaggtgtggaacaaggacagcagcagcaagaacctgatcccgcgcctgcagaagatttggaagaactacctgagcatgaacaagtacaaggtgagctacaagggtccgggtccgggcatcaagttcagcgcggaggcactgcgctgccacctgcgcgaccacgtgaacgtgagcatggtggaggtgacggacttcccgttcaacacgagcgagtgggagggctacctgccgaaggagagcatccgcacgaaggcgggaccgtggggtcgctgcgcagtggtgagcagcgcgggtagcctgaagagcagccagctgggccgcgagatcgacgaccacgacgcggtgctgcgcttcaacggtgcgccgacggcgaacttccagcaggacgtgggcacgaagacgacgatccgcctgatgaacagccagctggtgacgacggagaagcgcttcctgaaggacagcctgtacaacgagggcatcctgatcgtgtgggatccgagcgtgtaccacagcgacatcccgaagtggtaccagaacccggactacaacttcttcaacaactacaagacgtaccgcaagctgcacccgaaccagccgttctacatcctgaagccgcagatgccgtgggagctgtgggacatcctgcaggagatcagcccggaggagatccagccgaacccgccgagcagcggcatgctgggcatcatcatcatgatgacgctgtgcgaccaggtggacatctacgagttcctgccgagcaagcgcaagacggacgtgtgctactactaccagaagttcttcgacagcgcgtgcacgatgggtgcgtaccacccgctgctgtacgagaagaacctggtgaagcacctgaaccagggcacggacgaggacatctacctgctgggcaaggcgacgctgccgggattccgcacgatccactgcgcaggtgcttacccgtacgacgtgccggactacgcgtacccgtacgacgtgccggactacgcgtacccgtacgacgtgccggactacgcgtaagctagccttaagggtacccaccaccatcaccaccactaggcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccacca

SEQ ID NO: 72 - DNA, 9334 bp, Artificial Sequence
  pLMTB5896 ssu::LMSAP1 opti - cstI AAF13495-3HA; hyg marker (hygromycin resistance)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctatggcgagccgcctggtgcgcgtgctggcggcggcgatgctgatcctgatcctgatcgacgaggcggtggcgatgacgcgcacgcgcatggagaacgagctgatcgtgagcaagaacatgcagaacatcatcatcgcgggcaacggcccgagcctgaagaacatcaactacaagcgcctgccgcgcgagtacgacgtgttccgctgcaaccagttctacttcgaggacaaatactacctgggcaagaagatcaaggcggtgttcttcaacccgggcgtgttcctgcagcagtaccacacggcgaagcagctgatcctgaagaacgagtacgagatcaagaacatcttctgcagcacgttcaacctgccgttcatcgagagcaacgacttcctgcaccagttctacaacttcttcccggacgcgaagctgggctacgaggtgatcgagaacctgaaggagttctacgcgtacatcaagtacaacgagatttacttcaacaagcgcatcacgagcggcgtgtatatgtgcgcgatcgcgatcgcgctgggctacaagacgatctacctgtgcggcatcgacttctacgagggcgacgtgatctacccgttcgaggcgatgagcacgaacatcaagacgatcttcccgggcatcaaggacttcaagccgagcaactgccacagcaaggagtacgacatcgaggcgctgaagctgctgaagagcatctacaaggtgaacatctacgcgctgtgcgacgacagcatcctggcgaaccacttcccgctgagcatcaacatcaacaacaacttcacgctggagaacaagcacaacaacagcatcaacgacatcctgctgacggacaacacgccgggcgtgagcttctacaagaaccagctgaaggcggacaacaagatcatgctgaacttctacaacatcctgcacagcaaggacaacctgatcaagttcctgaacaaggagatcgcggtgctgaagaagcagacgacgcagcgcgcgaaggcgcgcatccagaaccacctgagctacaagctgggccaggcgctgatcatcaacagcaagagcgtgctgggcttcctgagcctgccgttcatcatcctgagcatcgtgatcagccacaagcaggagcagaaggcgtacaagttcaaggtgaagaagaacccgaacctggcgctgccgccgctggagacgtacccggactacaacgaggcgctgaaggagaaggagtgcttcacgtacaagctgggcgaggagttcatcaaggcgggcaagaactggtacggcgagggctacatcaagttcatcttcaaggacgtgccgcgcctgaagcgcgagttcgagaagggcgcaggtgcttacccgtacgacgtgccggactacgcgtacccgtacgacgtgccggactacgcgtacccgtacgacgtgccggactacgcgtaagctagccttaagggtacccaccaccatcaccaccactaggcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 73 - DNA, 9340 bp, Artificial Sequence
  pLMTB5897 ssu::SPinv native - cstI AAF13495-3HA; hyg marker (hygromycin resistance)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctatgatcgcgagcagcgtgcgccacgcggtgatcctgctgctggtggcggtggcgatgatggcggcggcggtgatcgcgatgacgcgcacgcgcatggagaacgagctgatcgtgagcaagaacatgcagaacatcatcatcgcgggcaacggcccgagcctgaagaacatcaactacaagcgcctgccgcgcgagtacgacgtgttccgctgcaaccagttctacttcgaggacaaatactacctgggcaagaagatcaaggcggtgttcttcaacccgggcgtgttcctgcagcagtaccacacggcgaagcagctgatcctgaagaacgagtacgagatcaagaacatcttctgcagcacgttcaacctgccgttcatcgagagcaacgacttcctgcaccagttctacaacttcttcccggacgcgaagctgggctacgaggtgatcgagaacctgaaggagttctacgcgtacatcaagtacaacgagatttacttcaacaagcgcatcacgagcggcgtgtatatgtgcgcgatcgcgatcgcgctgggctacaagacgatctacctgtgcggcatcgacttctacgagggcgacgtgatctacccgttcgaggcgatgagcacgaacatcaagacgatcttcccgggcatcaaggacttcaagccgagcaactgccacagcaaggagtacgacatcgaggcgctgaagctgctgaagagcatctacaaggtgaacatctacgcgctgtgcgacgacagcatcctggcgaaccacttcccgctgagcatcaacatcaacaacaacttcacgctggagaacaagcacaacaacagcatcaacgacatcctgctgacggacaacacgccgggcgtgagcttctacaagaaccagctgaaggcggacaacaagatcatgctgaacttctacaacatcctgcacagcaaggacaacctgatcaagttcctgaacaaggagatcgcggtgctgaagaagcagacgacgcagcgcgcgaaggcgcgcatccagaaccacctgagctacaagctgggccaggcgctgatcatcaacagcaagagcgtgctgggcttcctgagcctgccgttcatcatcctgagcatcgtgatcagccacaagcaggagcagaaggcgtacaagttcaaggtgaagaagaacccgaacctggcgctgccgccgctggagacgtacccggactacaacgaggcgctgaaggagaaggagtgcttcacgtacaagctgggcgaggagttcatcaaggcgggcaagaactggtacggcgagggctacatcaagttcatcttcaaggacgtgccgcgcctgaagcgcgagttcgagaagggcgcaggtgcttacccgtacgacgtgccggactacgcgtacccgtacgacgtgccggactacgcgtacccgtacgacgtgccggactacgcgtaagctagccttaagggtacccaccaccatcaccaccactaggcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 74 - DNA, 9334 bp, Artificial Sequence
  pLMTB5898 ssu::Spinv opti - cstI AAF13495-3HA; hyg marker (hygromycin resistance)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctatgatcgcgagcagcgtgcgccacgcgatggtgatcctgctgctgcacatgaacctgagcagcgtgatcgcgatgacgcgcacgcgcatggagaacgagctgatcgtgagcaagaacatgcagaacatcatcatcgcgggcaacggcccgagcctgaagaacatcaactacaagcgcctgccgcgcgagtacgacgtgttccgctgcaaccagttctacttcgaggacaaatactacctgggcaagaagatcaaggcggtgttcttcaacccgggcgtgttcctgcagcagtaccacacggcgaagcagctgatcctgaagaacgagtacgagatcaagaacatcttctgcagcacgttcaacctgccgttcatcgagagcaacgacttcctgcaccagttctacaacttcttcccggacgcgaagctgggctacgaggtgatcgagaacctgaaggagttctacgcgtacatcaagtacaacgagatttacttcaacaagcgcatcacgagcggcgtgtatatgtgcgcgatcgcgatcgcgctgggctacaagacgatctacctgtgcggcatcgacttctacgagggcgacgtgatctacccgttcgaggcgatgagcacgaacatcaagacgatcttcccgggcatcaaggacttcaagccgagcaactgccacagcaaggagtacgacatcgaggcgctgaagctgctgaagagcatctacaaggtgaacatctacgcgctgtgcgacgacagcatcctggcgaaccacttcccgctgagcatcaacatcaacaacaacttcacgctggagaacaagcacaacaacagcatcaacgacatcctgctgacggacaacacgccgggcgtgagcttctacaagaaccagctgaaggcggacaacaagatcatgctgaacttctacaacatcctgcacagcaaggacaacctgatcaagttcctgaacaaggagatcgcggtgctgaagaagcagacgacgcagcgcgcgaaggcgcgcatccagaaccacctgagctacaagctgggccaggcgctgatcatcaacagcaagagcgtgctgggcttcctgagcctgccgttcatcatcctgagcatcgtgatcagccacaagcaggagcagaaggcgtacaagttcaaggtgaagaagaacccgaacctggcgctgccgccgctggagacgtacccggactacaacgaggcgctgaaggagaaggagtgcttcacgtacaagctgggcgaggagttcatcaaggcgggcaagaactggtacggcgagggctacatcaagttcatcttcaaggacgtgccgcgcctgaagcgcgagttcgagaagggcgcaggtgcttacccgtacgacgtgccggactacgcgtacccgtacgacgtgccggactacgcgtacccgtacgacgtgccggactacgcgtaagctagccttaagggtacccaccaccatcaccaccactaggcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggcgatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 75 - DNA, 8541 bp, Artificial Sequence
  pLMTB6161 ssu::PtMGAT1; ble marker (zeocin resistance)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctatgctgaagaagcagtccgccggcctggtcctgtggggcgccatcctgttcgtcgcctggaacgccctgctgctgctgttcttctggacccggcccgcccccggccggcccccctccgtctccgccctggacgacgaccccgcctccctgacccgggaggtcatccggctggcccaggacgccgaggtcgagctggagcggcagcggggcctgctgcagcagatcggcgacgccctgtcctcccagcggggccgtgttcctaccgccgccccccccgcccagccccgtgttcctgtcacccccgcccccgccgtcatccccatcctggtcatcgcctgcgaccggtccaccgtccggcggtgcctggacaagctgctgcactatcggccctccgccgagctgttccccatcatcgtctcccaggactgcggccacgaggagaccgcccaggccatcgcctcctatggctccgccgtcacccacatccggcagcccgacctgtcctccatcgccgtcccccccgaccaccggaagttccagggctattataagatcgcccggcactatcggtgggccctgggccaggtcttccggcagttcggcttccccgccgccgtcgtcgtcgaggacgacctggaggtcgcccccgacttcttcgagtatttccaggccacctatcccctgctgaaggccgacccctccctgtggtgcgtctccgcctggaacgacaacggcaaggagcagatggtcgacgcctcccggcccgagctgctgtatcggaccgacttcttccccggcctgggctggctgctgctggccgagctgtgggccgagctggagcccaagtggcccaaggccttctgggacgactggatgcggcggcccgagcagcggcagggccgggcctgcatccggcccgaaatttctcggaccatgaccttcggccggaagggcgtctcccacggccagttcttcgaccagcacctgaagttcatcaagctgaaccagcagttcgtccacttcacccagctggacctgtcctatctgcagcgggaggcctatgaccgggacttcctggcccgggtctatggcgccccccagctgcaggtcgagaaggtccggaccaacgaccggaaggagctgggcgaggtccgggtccagtataccggccgggactccttcaaggccttcgccaaggccctgggcgtcatggacgacctgaagtccggcgtcccccgggccggctatcggggcatcgtcaccttccagttccggggccggcgggtccacctggcccccccccccacctgggagggctatgacccctcctggaactaatctagagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccgcatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgaccgactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 76 - DNA, 8541 bp, Artificial Sequence
  pLMTB6162 ssu::MaMGAT1; ble marker (zeocin resistance)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctatgctgaagaagcagtccgccggcctggtcctgtggggcgccatcctgttcgtcgcctggaacgccctgctgctgctgttcttctggacccggcccgcccccggccggcccccctccgtctccgccctgaacgacgaccccgcctccctgacccgggaggtcatccggctggcccaggacgccgaggtcgagctggagcggcagcggggcctgctgcagcagatcggcgacgccctgtggtcccagcggggccgtgttcctaccgccggcccccccgcccagccccacgtccccgtcacccccgcccccgccgtcatccccatcctggtcatcgcctgcgaccggtccaccgtccggcggtgcctggacaagctgctgcactatcggccctccgccgagcggttccccatcatcgtctcccaggactgcggccacgaggagaccgcccaggccatcgcctcctatggctccgccgtcacccacatccggcagcccgacctgtcctccatcgccgtcccccccgaccaccggaagttccagggctattataagatcgcccggcactatcggtgggccctgggccaggtcttccaccggttccggttccccgccgccgtcgtcgtcgaggacgacctggaggtcgcccccgacttcttcgagtatttccaggccacctatcccctgctgaaggccgacccctccctgtggtgcgtctccgcctggaacgacaacggcaaggagcagatggtcgactccggcaagcccgagctgctgtatcggaccgacttcttccccggcctgggctggctgctgctggccgagctgtgggccgagctggagcccaagtggcccaaggccttctgggacgactggatgcggcggcccgagcagcggaagggccgggcctgcatccggcccgaaatttctcggaccatgaccttcggccggaagggcgtctcccacggccagttcttcgaccagcacctgaagttcatcaagctgaaccagcagttcgtccacttcacccagctggacctgtcctatctgcagcgggaggcctatgaccgggacttcctggcccgggtctatgccgccccccagctgcaggtcgagaaggtccggaccaacgaccggaaggagctgggcgaggtccgggtccagtataccggccgggactccttcaaggccttcgccaaggccctgggcgtcatggacgacctgaagtccggcgtcccccgggccggctatcggggcatcgtcaccttccagttccggggccggcgggtccacctggcccccccccccacctgggagggctatgacccctcctggaactaatctagagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccgcatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgaccgactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 77 - DNA, 8547 bp, Artificial Sequence
  pLMTB6163 ssu::MuMGAT1; ble marker (zeocin resistance)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctatgctgaagaagcagaccgccggcctggtcctgtggggcgccatcatcttcgtcggctggaacgccctgctgctgctgttcttctggacccggcccgcccccggccggctgccctccgactccgccctgggcgacgaccccgcctccctgacccgggaggtcatccacctggccgaggacgccgaggccgagctggagcggcagcggggcctgctgcagcagatcaaggagcactatgccctgtggcggcagcggtggcgtgttcctaccgtcgccccccccgcctggccccgtgttcctgtcaccccctcccccgtccagatccccatcctggtcatcgcctgcgaccggtccaccgtccggcggtgcctggacaagctgctgcactatcggccctccgccgagcggttccccatcatcgtctcccaggactgcggccacgaggagaccgcccaggtcatcgcctcctatggcaccgccgtcacccacatccggcagcccgacctgtccaacatcgccgtccagcccgaccaccggaagttccagggctattataagatcgcccggcactatcggtgggccctgggccaaatttttaacaagttcaagttccccgccgccgtcgtcgtcgaggacgacctggaggtcgcccccgacttcttcgagtatttccaggccacctatcccctgctgcggaccgacccctccctgtggtgcgtctccgcctggaacgacaacggcaaggagcagatggtcgactcctccaagcccgagctgctgtatcggaccgacttcttccccggcctgggctggctgctgctggccgacctgtgggccgagctggagcccaagtggcccaaggccttctgggacgactggatgcggcggcccgagcagcggaagggccgggcctgcatccggcccgaaatttctcggaccatgaccttcggccggaagggcgtctcccacggccagttcttcgaccagcacctgaagttcatcaagctgaaccagcagttcgtccccttcacccagctggacctgtcctatctgcagcaggaggcctatgaccgggacttcctggcccaggtctatggcgccccccagctgcaggtcgagaaggtccggaccaacgaccagaaggagctgggcgaggtccgggtccagtatacctcccgggactccttcaaggccttcgccaaggccctgggcgtcatggacgacctgaagtccggcgtcccccgggccggctatcggggcatcgtcaccttccagttccggggccggcgggtccacctggcccccccccagacctggaccggctatgacccctcctggaactaatctagagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccgcatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgaccgactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 78 - DNA, 8547 bp, Artificial Sequence
  pLMTB6164 ssu::RnMGAT1; ble marker (zeocin resistance)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctatgctgaagaagcagtccgccggcctggtcctgtggggcgccatcatcttcgtcggctggaacgccctgctgctgctgttcttctggacccggcccgcccccggccggctgccctccgactccgccctgggcgacgaccccgcctccctgacccgggaggtcatccacctggccgaggacgccgaggccgagctggagcggcagcggggcctgctgcagcagatcaaggagcactattccctgtggcggcagcggtggcgtgttcctaccgtcgccccccccgcctggccccgtgttcctggcaccccctcccccgccgtcatccccatcctggtcatcgcctgcgaccggtccaccgtccggcggtgcctggacaagctgctgcactatcggccctccgccgagcacttccccatcatcgtctcccaggactgcggccacgaggagaccgcccaggtcatcgcctcctatggcaccgccgtcacccacatccggcagcccgacctgtccaacatcgccgtccagcccgaccaccggaagttccagggctattataagatcgcccggcactatcggtgggccctgggccaaatttttaacaagttcaagttccccgccgccgtcgtcgtcgaggacgacctggaggtcgcccccgacttcttcgagtatttccaggccacctatcccctgctgaaggccgacccctccctgtggtgcgtctccgcctggaacgacaacggcaaggagcagatggtcgactcctccaagcccgagctgctgtatcggaccgacttcttccccggcctgggctggctgctgctggccgacctgtgggccgagctggagcccaagtggcccaaggccttctgggacgactggatgcggcggcccgagcagcggaagggccgggcctgcatccggcccgaaatttctcggaccatgaccttcggccggaagggcgtctcccacggccagttcttcgaccagcacctgaagttcatcaagctgaaccagcagttcgtccccttcacccagctggacctgtcctatctgcagcgggaggcctatgaccgggacttcctggcccaggtctatggcgccccccagctgcaggtcgagaaggtccggaccaacgaccggaaggagctgggcgaggtccgggtccagtatacctcccgggactccttcaaggccttcgccaaggccctgggcgtcatggacgacctgaagtccggcgtcccccgggccggctatcggggcatcgtcaccttccagttccggggccggcgggtccacctggccccccccgagacctggaacggctatgacccctcctggaactaatctagagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccgcatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgaccgactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 79 - DNA, 8562 bp, Artificial Sequence
  pLMTB6165 ssu::DrMGAT1a; ble marker (zeocin resistance)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctatgctgcggaagcggtcccccctggtcatctgcggcgccttcatcttcgtcgcctggaacgtcgtcctgctgttcgtcctgatgcggcggccctcctcccccggcaccttcaacaaccaggacaagcccggcgagaccgagcaccgggccgagggcggcaagttcggcaacatcatgaacgaggtcatccgggtcgccgacgccttcgaggccgagctggccgcccagaagaagatcctgcagcagatccagtcccactggtccgtctgggactccaaggacggcgtcatccccgagaagtccaagtccgaggtcgagcacaccgcccccgtcgtcatccccatcctggtcatcgcctgcaaccgggtcaccgtcaagcggtgcctggacaagctgatcgagcaccggccctccgccgagctgcaccccatcatcgtctcccaggactgcggccaccgggagacctccgacgtcatcggctcctatggctcccagctgacccacatcaagcagcccgacctgtccgacgtcgccgtccccccccagcacaagaagttccagggctattataaaatttctcggcactataagtgggccctgtcccaggtcttcaacaccttctcctattcctccgtcgtcgtcgtcgaggacgacctggaggtcgcccccgacttcttcgagtatttccgggccctgcaccccatgctgaagtccgaccccaccctgtggtgcgtctccgcctggaacgacaacggccgggacggcttcgtcgaccccggcaaggcctccctgctgtatcggaccgacttcttccccggcctgggctggatgctgaccaaggacctgtgggccgagctggagcccaagtggcccgcctccttctgggacgactggatgcggcaccccgaccagcggaaggaccggtcctgcatccggcccgaaatttctcggaccctgaccttcggccggaagggcgtctccctgggccagttctatgacaagtatctgcggttcatcaagctgaacaccgagttcgtccccttcaccaagatggacctgtcctatctggagaaggagaagtatgacgagtccttcgagaaggaggtctatgccgcctccctggtcaccctggaggacctgaagtccggcaagctgtccggctccggccccttccgggtccagtattcctcccccgactccttcaagtccctggcccggaacctgggcgtcatggacgacctgaagtccggcgtcccccgggccggctatcggggcgccgtctccttcctgctgcggggcaagcgggtctatctggccccccccgccggctggtcccggtatgacccctcctggtcctaatctagagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccgcatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgaccgactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 80 - DNA, 8580 bp, Artificial Sequence
  pLMTB6166 ssu::DmMGAT1; ble marker (zeocin resistance)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctatgcggacccggaaggtcctgctggtcatcggcttcctggtcacctggacctatgccacctattatctgctgctgcggcagaccggcatccacacctcccggcaccagtccctgcaggcctataagctgaactcccaggcccgggacgccaacatgcagtcccaccacctggccaagaacgtcttcgagttcgtcaagctgaagtatctggagaagcagcccccctccgtcgcctccaccccccaaatttctatcatcgccgccgaaatttctgccgagctgcccgagcagcacgtcgccaagtccgccaccgcccggatccccaccaagacctatctggccaacggcgagcccgtcttccccgtcgtcgtcttcgcctgcaaccgggtctccgtcaagaagtgcatcgacaacctggtccagtatcggccctccgtcgagcagttccccatcatcgtctcccaggactgcggcgacgagcccaccaaggaggccatcctgtcctatggcaagcaggtcaccctgatcgagcagcccgacctgtccgacatcaccgtcctgcccaaggagaagaagttcaagggctattataagatcgcccggcactatggctgggccctgaacaccaccttcgccgtcggcttcgagttcgtcatcatcgtcgaggacgacctgaacgtcgcccccgacttcttcgagtatttcctgggcacccacaagctgctgaagcaggacccctccctgtggtgcgtctccgcctggaacgacaacggcaaggccgccgtcgtcgacgccgcccagcccgagctgctgtatcggaccgacttcttccccggcctgggctggatgctgaccaaggacctgtgggccgagctgtccgtcaagtggcccaagtccttctgggacgactggatccggcaccccgcccagcggaaggaccgggtctgcatccggcccgaaatttctcggacccggaccttcggcaagatcggcgtctccaacggcctgttcttcgacaagtatctgaagcacatcaagctgtccgaggacttcgtccagttcaccaagatcaatatgtcctatctgctgaaggacaactatgacaacaccttcctgcggcgggtctatacctatcccatcgtcacctatgacgagctgcggcggaacctgatccggatcgagggccccgtccggatccagtataccacccgggagcagtataagcggaccaccaagatgctgggcctgatggacgacttcaagtccggcgtcccccggaccgcctatcacggcatcgtctccttctattataacaagcggcgggtccacctggcccccaacgccaactggaagggctatgagctgtcctggtcctaatctagagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccgcatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgaccgactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 81 - DNA, 8604 bp, Artificial Sequence
  pLMTB6167 ssu::AgMGAT1; ble marker (zeocin resistance)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctatgcggccccggaagaccatcctgctggtcggcgtcctggtcatctgggtcctgatgacctatctggccttcatgcggtccgtccggggcaccgacggctcccggccccggcccgccttcgcctccaacaagctgatgctggagaaggtccaggacttcgagcagaacctgaagtccttcgccgactcccggcagaacctgtatcgggacatcatcaacatcctgcggcggaccgacaaggtctcctccgtccccgcccagcccatccccgccgtcccctcccaggagtcccccggcgccgccgtccaggagtccgaggtccccaaggagcggcaggcccccccccagcggtatctgaacaacgaccccgccttccccgtcatccccgtcgtcgtcttcgcctgcaaccggatctccgtcaacaagtgcctggacgacctgatccggtatcggccctccgccgagcagttccccatcatcgtctcccaggactgcgacgacgaggccacccggaacaccatcctgtcctatcgggacgaggtcaccctgatccagcagcccgaccagtccgacatccccgtcccccccaaggagaagaagtataagggctattataaaatttctcggcactatggctgggccctgcgggccgtcttcggccagggcttcgactccgtcatcctggtcgaggacgacctgtccgtcgcccccgacttctatgagtatttcctgggcacctatcccatcctgaagcgggacaagtccctgtggtgcgtctccgcctggaacgacaacggcaaggagggcctgatcgacaccaccgcccacgacctgctgtatcggtccgacttcttccccggcctgggctggatgatgaccaaggacctgtgggacgagctggagcccaagtggcccaaggccttctgggacgactggatccggcagcccgagcagcggaaggagcgggcctgcatccggcccgagctgccccggacccggaccttcggcaagatcggcgtctccaacggcctgttcttcgacaagcacctgaagttcatcaagctgtccgaggagttcgtctccttcaccaagaccaacctgtcctatctggtcaagtccgcctatgacgacgccttcctgaagaccgtctatcagtcccccgtcgtcaccctggacgagctgaagcggggcatggtcatgacccgggagcccatccggatcgcctatcacaccaaggagcagtataagcgggccaccaagaacctgggcctgatggacgacttcaagtccggcgtcccccggaccgcctatcggggcgtcgtctccttcttctataacggccagcgggtctatctggccccctccgccaactggaagggctatgacctgacctggtcctaatctagagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccgcatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgaccgactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 82 - DNA, 8517 bp, Artificial Sequence
  pLMTB6168 ssu::Ce14MGAT1; ble marker (zeocin resistance)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctatgcacatctcctccaagatcaccttcatcttcgtcctgatctatttctcctggaacttctatatccagaacggcttcaccaacaaggccatcgtcaaggaggagctgcggctgctgaaggagatggacgaggccggctcccggctggagaagctgctgaaggtcgagaaggagcacatggagcggctgtccgagaccatgaaccgggccacccggctgcggatcacccccaactccaacaaccccaacaactggccccaccccatccccgtcatcgtcttctcctgcaaccggcccgactccgtccgggcccacgtcgagaagctgatcatgtatcggccctccgcccagcagttccccatcaccgtctcccaggactgcgacaacgagtccgtcaagaaggaggtcgagaagttcggcaactccgtcaactatgtcaagcacccccccggcgagtccgtcaagatcgagatccccaccaacctgcagaagttcaagccctattattatatctcccggcactataagctggccctgaaccacatcttctccaactccaacaactattcctccgtcatcatcaccgaggacgacctggacatcgcccccgacttcttctcctatttctccaacacccggtatctgctggagaaggacccctccctgtggtgcgtcaccgcctggaacgacaacggcaagcccgagaacatcgacctgaagtccaacgccaccctgtatcggtccgacttcttcgccggcctgggctggatgatgacccggaagacctgggaggagctggagcccatctggcccaacggcttctgggacgactggatgcgggagcccgtccagcggaagcagcggcagtgcatccggcccgaaatttctcggaccggcatgatgaagtatggcaaggagggcacctccaagggccagttcttctccgaccacctggagaagatcaaggtcaacgacctgcccgtcgacttctcccagatcaacctggactatctgcagaagaacgagttcgagtcccggctgtccctggacatccggaacgccgtccccgtcgacatcgacgacatcacctatcccgactggaagcccgactatgagggcatgaaggccatcatctattataccggccggaccgacttcgtcgccaaggccgaccggctgtccctgatgcacgacttcaaggccggcgtcccccggaccgcctataacggcatcgtcacctgcttctataagggcacccggatcttcctggtccccgaccggtccaaggtccccggctatgactcctcctggtaatctagagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccgcatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgaccgactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 83 - DNA, 8553 bp, Artificial Sequence
  pLMTB6169 ssu::Ce13MGAT1; ble marker (zeocin resistance)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctatgcacgccgtcaccaaaatttttatcatcttcatcttcgtcttcatcctgtggaccctgtatgtcgagaacgacatcaccaaccggacccggaacaccgacaacatcgacgacctgctggagtccgccaaccggctggagcggctgctgaagttcgaggccaagaagatcgccgccctggccgaggacgtccacaagatccgggccaaccggaagggcaagcacgtcatcatggaggagatggtctcccaggacctgaagcagtggaaggaccccatccccgtcctggtcttctcctgcaaccgggccatggccgtccgggaccacgtcgagaagctgatccggtatcggccctcccaggagaagttccccatcatcgtcacccaggactgcgacaacgagaacgtcaagaacgaggtcaagaagttcggcgacaaggtcgagtatatcaagcacctggccggcgacaaggccaacatcaccatccccccctcccaccggcagtataccgcctattatcggatcgcccggcactataagctggccctgaaccacgtcttcgtcgacaagggctattcctccgtcatcatcaccgaggacgacctggacatctcccccgacttcttctcctatttctcctccacccggtatctgctggagaacgacgagaagctgtggtgcgtcaccgcctggaacgacaacggcaagcaggagaacatcgacatgaccgccgcctccaccctgtatcggtccgacttcttcgccggcctgggctggatgatgtcctccaagacctggcacgagctggagcccatctggcccgtcggcttctgggacgactggatgcgtgatcctgcccggcggaaggaccggcagtgcatccggcccgaaatttctcggaccggcatgatgtcctatggcaaggagggcgcctccaagggccagttcttctccaagcacctggccaagatcaaggtcaacgacaagtatatcaacttcggcaagatcgacctggactatctgctgcccgccaacttcgccaagaagaccaacctggaggtcatgaaggaggccgtcgagctgtccatcgacaacgtcgcctccttcgtcctgtcctccgagaacaagggcaagtccgtccgggtcatgtatgacggcaacatcgactatatccggaaggccgacaagctgcacatcatgcacgacttcaaggccggcgtcccccggaccgcctatgacggcatcgtcacctgcttcatcaacggcatccggatctatctggtccccgaccggaccaaggtctccgcctataaccccgactggtccgtccccccctccttcggcgagtaatctagagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccgcatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgaccgactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 84 - DNA, 8538 bp, Artificial Sequence
  pLMTB6170 ssu::AtMGAT1; ble marker (zeocin resistance)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctatggcccggatctcctgcgacctgcggttcctgctgatccccgccgccttcatgttcatctatatccagatgcggctgttccagacccagtcccagtatgccgaccggctgtcctccgccatcgagtccgagaaccactgcacctcccagatgcggggcctgatcgacgaggtctccatcaagcagtcccggatcgtcgccctggaggacatgaagaaccggcaggacgaggagctggtccagctgaaggacctgatccagaccttcgagaagaagggcatcgccaagctgacccagggcggccagatgcccgtcgccgccgtcgtcgtcatggcctgctcccgggccgactatctggagcggaccgtcaagtccgtcctgacctatcagacccccgtcgcctccaagtatcccctgttcatctcccaggacggctccgaccaggccgtcaagtccaagtccctgtcctataaccagctgacctatatgcagcacctggacttcgagcccgtcgtcaccgagcggcccggcgagctgaccgcctattataagatcgcccggcactataagtgggccctggaccagctgttctataagcacaagttctcccgggtcatcatcctggaggacgacatggagatcgcccccgacttcttcgactatttcgaggccgccgcctccctgatggaccgggacaagaccatcatggccgcctcctcctggaacgacaacggccagaagcagttcgtccacgacccctatgccctgtatcggtccgacttcttccccggcctgggctggatgctgaagcggtccacctgggacgagctgtcccccaagtggcccaaggcctattgggacgactggctgcggctgaaggagaaccacaagggccggcagttcatccggcccgaggtctgccggacctataacttcggcgagcacggctcctccctgggccagttcttctcccagtatctggagcccatcaagctgaacgacgtcaccgtcgactggaaggccaaggacctgggctatctgaccgagggcaactataccaagtatttctccggcctggtccggcaggcccggcccatccagggctccgacctggtcctgaaggcccagaacatcaaggacgacgtccggatccggtataaggaccaggtcgagttcgagcggatcgccggcgagttcggcatcttcgaggagtggaaggacggcgtcccccggaccgcctataagggcgtcgtcgtcttccggatccagaccacccggcgggtcttcctggtcggccccgactccgtcatgcagctgggcatccggaactcctaatctagagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccgcatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgaccgactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 85 - DNA, 8532 bp, Artificial Sequence
  pLMTB6171 ssu::OsJMGAT1; ble marker (zeocin resistance)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctatggcccggtccccctgcgacctgcggatcctgctggtcgccgccgccgccgccttcatctatatccaggtccggctgttctccacccagtcccactatgccgaccggctggcccaggccgagaagtccgagaaccagtgcacctcccagctgcggtccctgatcgaccaggtctcctcccagcaggagaagatcgtcgccctggaggagatgaagatccggcaggacgaggagcgggtccacctgaagatcctgatccaggacctggagaagcggtccgtccagaccctggtcaacaacaacgtcgcccccgtcgccgccgtcgtcgtcatggcctgcaaccggcccgactatctgcagcggaccgtcgagtccatcctgaagtatcagacctccgtcgcctccaagttccccctgttcatctcccaggacggcatcaacggcgaggtcaagaagaaggccctgtcctataacgagatcacctatatgcagcacctggacctggagcccgtccggaccgagcggcccggcgagctgatcgcctattataagatcgccaagcactataagtgggccctggacgagctgttcatcaagcacaacttcgcccgggtcatcatcctggaggacgacatggagatcgcccccgacttcttcgactatttcgaggccgccgccaagctgctggacaacgacaagaccatcatggccgtctcctcctggaacgacaacggccagaagcagttcgtctatgaccccaaggccctgtatcggtccgacttcttccccggcctgggctggatgctgaccaagcccacctggatcgagctgtcccccaagtggcccaaggcctattgggacgactgggtccggctgaaggaggtccaccgggaccggcagttcatccggcccgaggtctgccggacctataacttcggcgagcacggctcctccatgggccagttcttccggcagtatctggagcccatcaagctgaacgacgcccacatcaagtggaactccgaggacctgtcctatctgaaggaggacaagttcctgatccagttcggcaaggacgtcgcctccgccacccccctgcacggctccgacgccgccctgaaggcccacaacatggacgccgacgtccggatccagtataacgaccaggaggacttcgagcggatcgcccggcagttcggcatcttcgaggagtggaaggacggcatcccccggaccgcctataagggcgtcgtcgtcttccggtataagtcctcccggcggcggatctatctggtcggccccgactccctgtcccagctgcgggtctaatctagagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccgcatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgaccgactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 86 - DNA, 8547 bp, Artificial Sequence
  pLMTB6172 ssu::XtMGAT1; ble marker (zeocin resistance)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctatgccccggaaggtctccgtcgccgcctggggcgccgccctgttcatctcctggaacgccatcctgctgctgtatctgatgtcccggtcccggggcaccgaccactccgacctgaccgcccacgtcatccagctggccgaggccgccgaggccgagctggagaagcagaagggcctgctgcagcagatccactattattccggcctgctgaacaaccagcagtccccctcccacgtccggcccgcccccgtcatccccatcaagaagtccaatatgtcctccacctcctcccccgtccggtccgaccccctgtccctggtcatccccatcctggtcgtcgcctgcgaccggccctccgtccggcggtgcctggactccctgctgaagtatcggccctccgccgagaagttccccatcatcgtctcccaggactgcggccacgaggagaccggcaaggtcatcgactcctatggcgacgccgtcacccacatcaagcagcccgacctgtccgaggtcgccgtcccccccgagcaccggaagttccagggctattataaaatttctcggcactatcggtgggccctgaaccaaatttttaagaccatgggctataaggccgccatcgtcgtcgaggacgacctggaggtcgcccccgacttctatgagtatttccaggccaccctgaccctgctgcagaaggaccacatgctgtggtgcgtctccgcctggaacgacaacggcaaggaggccctgatcgaccccggcggcaactccctgctgtatcggtccgacttcttccccggcctgggctggctgctgctgcgggagctgtgggaggagctggagcccaagtggccctccgccttctgggacgactgggtccggcggcccgagcagcggctggagcgggcctgcgtccggcccgagctgtcccggacccggaccttcggccggaagggcgtctcccagggccagttcttcgaccagcacctgcggttcatcaagctgaaccaggaccccgtcgccttctccaagatggacctgtcctatctgctgaaggacaactatgaccccatgttcctggagcaggtctatggcgcccccaaggcccgggccgaggaggtcctgcacggccaggtccccggcggccggaccgtccgggtcgagtataccaccaaggacaccttcaaggccatggcccgggccttcggcgtcatggaggacctgaagtccggcgtcgcccgggccgcctataagggcgtcgtctccttcacccaccggggccggcgggtcttcctggccccccccaaggactggaccggctatgacccctcctggtcctaatctagagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccgcatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgaccgactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 87 - DNA, 10137 bp, Artificial Sequence
  pLMTB6173 ssu::Stt3A_d90 SfGnt-I strep; ble marker (zeocin resistance)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctatgcggtcgatggcgggtgagttcgacaatgagtgcatcgccgtggcagccatgctcctcaccttctactgctggatgcgctcgctgcgcacacggtcctcgtggcctatcggagtcctcaccggtgtcgcctacggctacatggtggcggtgtggggcggctacatctttgtgctcaacatggttgccatgcatgccggcgtctcctcgatggtggactgggctcacaacacgtacaacccgtccctgctgcgtgcatacacgctgttctacgtcgtcggcactgccatcgccacgcgtgtgccgccagtggggatgtcgcccttcaagtcactggagcagctgggtgcacttctggtgcttgtcttcctgtgtgtgctgcatgtgtgcgaggtgttgcgggcacgcgccggtgtagaggttcgttcccgcgcgaacttcaagatccgcgtgcgcgttttcagcatgatggctggcgtcgctgcacttgtagttgcggtgctggcgccgacggggtacttcgggcccctttcggcgcgcgtgcgcgcactgttcgtgaagcacacgcggactggcaatccgctggtcgactcggtcgccgagcacagcaagacacaaccggaggcgtatatatttttcctggacttcacctactcgttgtggatgttgggcacagtattgcaagcgttcggtacggccatgtggtcacggaaggaagcgcagctgtttatgggactctactccctcgccacctactacttttcagatcgtatggcgcgcttgatggtgctagcggggcctgcggctgcggcaggtacggcaggtatcctgggcatcgtatacgaatggtgctgggcgcagctgaccgggtgggcgtccccgagcctctctgctgcaggcagcgaaagagaaacaggctttaaggacaatgcaggaagtgctgaaaggctcgccagcaccggcacgcgtaagcgtggggtgcgagcgcacgctatcgccgctgtatcgtcaataaagtcttctgtggaccttcttcctcaggcgttgcgagttggcctcgctgtggccattattgccgccaccgttggtgcgccgtacgtctctgagtttcaggctcgctgtattcagtctgcttactcctttgctggaccgcgtatcgtgttccaggcacagctgcgctccggagagaagctgatggtaaaggactacctcgaggcatacgagtggctgcgcgacagcacgccccagaatgcacgcattttagcctggtgggactacggctaccagatcacgggcatcgccaaccgcacctcgctggccgatggcaacacctggaaccacgagcatatcgccaccatcggcaagatgctgacgtcgcccgtggcgaaggcacactcgctggtgcgtcacatggccgactacgtcctgatctggactgggcagaacggagacttgatgaagtcaccgcacatggcacgcattggcaacagtgtataccacgacatctgccccaatgatccgcggtgccagcaattcggtttttacagaaatgattttaatcgcccaacaccgatgatgcgggcgtcgctgctctacaacctgcacgaggtcggaaaagcaaagggcgtggaggtggacccatccctctttaaggaggtctactcgtccacgtacggcctggtgcgcatcttcaaggtcatgaacgtaagcaaggagagcaagaagtgggttgctgacccggcaaaccgcgtgtgccacccccctgggtcgtggctctgcccggggcagtaccctccagcgaaggagatccaggacatgctggcgcaccgtgcgggcgccgaggtcatgcagcacctgtcccagcccatcctgcccgtcctggtcatcgcctgcgaccgggtcaccgtccagcggtgcctggacaacctggtcaagttccggccctccaaggagaccttccccatcatcgtctcccaggactgcggccacaacgccacctatgaggtcatcacctcctataccgcctccgaccccaccatctccgtcgtccggcagcccgacctgtccgagatcgtcctgccccgggtcaaggtcaagttccggggctattataagatcgcccggcactataagttcgccctgaaccacgtcttcgagaccctgggccacgaggccgtcatcatcgtcgaggacgacctggacatctcccccgacttcttcgagtatttcctgggcacctatcccctgctgctgaaggacccctccctgtggtgcatctccgcctggaacgacaacggcaagatggaggtcatcgatatgtcccggcccgacctgctgcaccggaccgacttcttccccggcctgggctgggtcctgcggcgggagatgtggcggaagctggcccccaagtggcccaccgccttcttcgacgactggctgcggaaccccgtcaacatcgacggcaaggcctgcatccggcccgaaatttctcggacctattccttcggcaaggtcggcgtctccaagggcctgttcttcgacctgcacctgcggaacatccagctgaacatggagtatgtcgagttcaccaagctgaacctgacctatctgctgaaggagcactatgacgacgccctggtctccaccgtctataacctgcccgagatgtccgcctccgaggtcgtcgccggctccgacctgtccgccgaccccgtccgggtcatgtattccaacgccaagacctatcagcgggccgccaagaagctgggcctgatggacgacttccggtccggcgtcccccggaccgcctatcggggcatcgtcacctgcttcatccggggccggcgggtctatctggccccctccttcgagtggaacaagtatgaccccacctggggcgcgggcgcctggtcccacccgcagttcgagaagtaatctagagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccgcatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgaccgactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 88 - DNA, 8547 bp, Artificial Sequence
  pLMTB6306 ssu::ClMGAT1; ble marker (zeocin resistance)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctatgctgaagaagcagtccgccggcctggtcctgtggggcgccatcctgttcgtcgcctggaacgccctgctgctgctgttcttctggacccggccctccccctcccggctgccctccgactccgccctggacgacgaccccgcctccctgacccgggaggtcatccggctggccgaggacgccgaggtcgagctggagcggcagcggggcctgctgcagcagatccgggagcaccacgcccggtggtcccagcggtggcgtgttcctaccgccgccccccccgcccccccccgtgttcctgtctcctccccccccgccgtcatccccatcctggtcatcgcctgcgaccggtccaccgtccggcggtgcctggacaagctgctgcactatcggccctccgccgagcacttccccatcatcgtctcccaggactgcggccacgaggagaccgcccaggtcatcgcctcctatggctccgccatcacccacatccggcagcccgacctgtcctccatcaccgtcccccccgaccaccggaagttccagggctattataagatcgcccggcactatcggtgggccctgggccaggtcttccacaagttcaagttccccgccgccgtcgtcgtcgaggacgacctggaggtcgcccccgacttcttcgagtatttccaggccacctatcccctgctgcgggccgacccctccctgtggtgcgtctccgcctggaacgacaacggcaaggagcagatggtcgactcctccaagcccgagctgctgtatcggaccgacttcttccccggcctgggctggctgctgctggccgagctgtgggccgagctggagcccaagtggccccgggccttctgggacgactggatgcggcggcccgagcagcggcagggccgggcctgcgtccggcccgaaatttctcggaccatgaccttcggccggaagggcgtctcccacggccagttcttcgaccagcacctgaagttcatcaagctgaaccagcacttcgtccccttcacccagctggacctgtcctatctgcggcaggagacctatgaccgggacttcctggcccgggtctatggcgcccccctgctgcaggtcgagaaggtccggacctccgagcggtccgagctgggcgaggtccgggtccagtataccggccgggactccttcaaggccttcgccaaggccctgggcgtcatggacgacctgaagtccggcgtcccccgggccggctatcggggcatcgtctccttcctgttccggggccggcgggtccacctggcccccccccagacctgggacggctatgacccctcctggaactaatctagagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccgcatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgaccgactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 89 - DNA, 8547 bp, Artificial Sequence
  pLMTB6307 ssu::BtMGAT1; ble marker (zeocin resistance)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctatgctgaagaagcagtccgccggcctggtcctgtggggcgccatcctgttcgtcgcctggaacgccctgctgctgctgttcttctggacccggcccgcccccggccggctgccctccgactccgccctggacgacgaccccgcctccctgacccgggaggtcatccggctggcccaggacgccgaggtcgagctggagcggcagcggggcctgctgcagcagatccgggagcaccacgcccggtggtcccagcggtggcgtgttcctaccgtcgccccccccgtccccccccgtgttcctgtcaccaccccccccgccgtcatccccatcctggtcatcgcctgcgaccggtccaccgtccggcggtgcctggacaagctgctgaactatcggccctccgccgagcacttccccatcatcgtctcccaggactgcggccacgaggagaccgcccaggtcatcgcctcctatggctccgccgtcatgcacatccggcagcccgacctgtccaccatcgccgtcccccccgaccaccggaagttccagggctattataagatcgcccggcactatcggtgggccctgggccaggtcttccacgagttcaagttccccgccgccgtcgtcgtcgaggacgacctggaggtcgcccccgacttcttcgagtatttccaggccacctatcccctgctgcgggccgacccctccctgtggtgcgtctccgcctggaacgacaacggcaaggagcagatggtcgactcctccaagcccgagctgctgtatcggaccgacttcttccccggcctgggctggctgctgctggccgagctgtgggccgagctggagcccaagtggcccaaggccttctgggacgactggatgcggcggcccgagcagcggcagggccgggcctgcgtccggcccgaaatttctcggaccatgaccttcggccggaagggcgtctcccacggccagttcttcgaccagcacctgaagttcatcaagctgaaccagcacttcgtccccttcacccagctggacctgtcctatctgcggcaggagacctatgaccgggacttcctggcccgggtctatggcgcccccctgctgcaggtcgagaaggtccggacctccgagcggtccgagctgcaggaggtccgggtccagtatacctcccgggactccttcaaggccttcgccaaggccctgggcgtcatggacgacctgaagtccggcgtcccccgggccggctatcggggcatcgtctccttcctgtatcggggccggcgggtccacctggcccccccccagacctgggacggctatgacccctcctggaactaatctagagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccgcatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgaccgactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 90 - DNA, 8778 bp, Artificial Sequence
  pLMTB6308 ssu::DrMGAT1b; ble marker (zeocin resistance)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctatggtccggaagaagggctccctgatcctgtgcggcgccttcctgttcgtcgcctggaacgccctgctgctgctgttcctgtggggccggccccccatcggccggctgggcgagggcggcggcgccgagcccggcgccggcgaggagtggggcgccggcaagtccaaggtcggcggcgccaacggcctggccggcgaggtcatccggctggccgaggaggtcgagtccgagctggagacccagaagaagctgctgaagcagatccagtcccaccgggagctgtgggagcagcggaaggagctggagaagcgggagtccgaggacaccaaggacgagaagatcgacgtcgagcccaagaagccccggcagatccccgccgtccacctgtcccacaaggtcgtcgaggacgcccagaccgtcaccaagaagatgcagaccctgatggtcacccccccccagctggtcatgaaggagcaggagaccgaccagaagaacaagcagatgatggaggaccagctgggcctgaccaccccctccccccagatcatcatccccatcctggtcatcgcctgcgaccgggtcaccgtcaagcggtccctggaccggctgatccagtatcggccctccgccgagctgtatcccatcatcgtctcccaggactgcggccacgccgacaccgcccgggtcatcggctcctatggctcccagatcacccacatctcccagcccgacctggccgacatccccgtccggcccgaccaccggaagttccagggctattataagatcgcccggcactatcggtgggccctgaaccaggtcttcaacgtcttcgcctattccaccgtcgtcatcgtcgaggacgacctggaggtcgcccccgacttcttcgagtatttccgggccctgtatcccatcctgcggtccgaccccaccctgtggtgcatctccgcctggaacgacaacggccgggacggcctggtcgaccccggcaaggccgagctgctgtatcggaccgacttcttccccggcctgggctggatgctgctgaaggaggtctgggccgagctggagcccaagtggcccaaggccttctgggacgactggatgcggcaccccgagcagcggaagaaccggtcctgcatccggcccgaaatttctcggaccatcaccttcggccggaagggcgtctccctgggccagttcttcgaccagtatctgcggtatatcaagctgaacaccgagttcgtccccttcaccaagcacgacctgtcctatctggtccgggagaagtatgacgtctccttcgagaaggacgtctattccgcccccctggtcaaggtcgaggagctgcagcacggcggctccctgaagggctccggccccttccgggtccagtattcctcccgggactccttcaaggtcctggcccggaacctgggcgtcatggacgacctgaagtccggcgtcccccgggccggctatcggggcgtcgtctccttcatctcccggggccggcggatctatctggccccccccgagggctggaccaagtatgacgtctcctggtcctaatctagagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccgcatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgaccgactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 91 - DNA, 8550 bp, Artificial Sequence
  pLMTB6309 ssu::GjMGAT1; ble marker (zeocin resistance)
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgacgcgtattgggatatttaaattggataacttggcgaaacgccaagctaatacatgaaccaaccgggtgttctccactccagacggtgggcaaccatcgtcgtgagacgcccagcgaatgaatgacagtaaaaccaatgccttcactggcagtaacacccagcagtgttgactcaattcattccgtgcgaaagccggcttgttccggcgtcttttgacgaacaactgccctatcagctggtgatggccgtgtagtggactgccatgcatggcgttgacgggagcgggggattagggttcgattccggagagggagcctgagaaatagctaccacttctacggagggcagcaggcgcgcaaattgcccaatgtcaaaacaaaacgatgaggcagcgaaaagaaatagagttgtcagtccatttggattgtcatttcaatgggggatatttaaacccatccaatatcgagtaacaattggaggacaagtctggtgccagcacccgcggtaattccagctccaaaagcgtatattaatgctgttgctgttaaagggttcgtagttgaactgtgggctgtgcaggtttgttcctggtcgtcccgtccatgtcggatttggtgacccaggcccttgcagcccgtgaacattcaaagaaacaagaaacacgggagtggttcctttcctgatttacgcatgtcatgcatgcgtcgaagatccagtcgcagcctgaccgcatcacacatcaaggcgttacagcctctccgtctttgctgcacccaagtgtattcgtgtgaccgcgttgagggatctaatggattcggaactttggtcgtttggtctctcatgctgcccaatcccatgcgcttttctccgtgcctctctgtctccccttccgttctatttggacaacgatgtgtactgtaatgcgtgcgccatctgacaacgaatagatcagcagcattcgcacacttgcacatacccagtgaagcttttgtgtctgtcgtattgacaacaccgactgcaacaaggtgtagatagaagttggccttctcgctcgctcgcacgctcttcacgctcctgctttccttgctgtgccttgccaccagatctatgctgaagaagtcctccctggtcctgtggggcgtcgtcctgttcgtcgcctggaacgccctgatcctgttcttcctgtggacccggccccagtccctgtccgaccactcccacctgaccgaggaggtcatccggctggcccaggacgccgagtccgagctggagcggcagaaggacctgctgcagcaaatttaccggtattccgccctgtggtcccggcggaaggcctccgaggccaagctgcacccccccgtcgccgcctccgcccagccctccaccgccgcccccctgtcccaccactcccaaatttctcccgacgccgtcctgcccgtcctggtcatcgcctgcgaccggtccaccgtccggcggtgcctggacaagctgctgcactatcggccctcccaggagcggttccccatcatcgtctcccaggactgcggccacgacgagaccgcccgggtcatcgcctcctatggcgacgccatcatgcacatcaagcagcccaacctgtccgacatccccgtccccaccgaccaccggaagttccagggctattataagatcgcccggcactatcactgggccctgtcccaggtcttccggaccttccagtatcaggccgccatcgtcgtcgaggacgacctggaggtcgcccccgacttcttcgagtatttccaggccgccttccccctgctgctggccgaccccaccctgtggtgcgtctccgcctggaacgacaacggcaaggagcagatggtcgacgccgcccaccccgacctgctgtatcggaccgacttcttccccggcctgggctggctgctgctgtccgacctgtggaacgagctggagcccaagtggcccaaggccttctgggacgactggatgcggcagcccgagcagcggcagggccggtcctgcatccggcccgaggtctcccggaccatgaccttcggccggaagggcgtctcccacggccagttcttcgaccagcacctgaagttcatcaagctgaacgaccacttcgtccccttcacccagatggacctgtcctatctgaagaagaacgagtatgaccggtccttcctggaccaggtctatggcgcccccgagctgcgggtcgaggagctgcagggcaaccggcggcgggagctgggcaccgtccgggtccagtataccacccgggactccttcaaggccttcgccaaggccctgggcgtcatggacgacctgaagtccggcgtcccccgggccggctatcggggcatcgtctccttcctgtatcagtcccggcgggtctatctggcccccccctccgactggaccggctatgacccctcctggtcctaatctagagcggccgccctcctcctcctttcttgttcctttcacgtcgccttctcggttgtagctggcagacgacgagtcttacttttacgtgtacttctctatagatgatgtatgatctctctgcatgcgtgttcgtgcatgtgtccgtgtgttgtgtacgcgtgcgtctcgcctcagctctccgcgtgaaagggtttgactgcccatgatgcgtgtgtatatccacgcgcaggcacgcacacacacacacacacacacacacacaggcacacacaggcacacaaacgcatctcaggccgagccgcatacgtctctcgcacggtctcgtttatttgatcatgtagttgagtattaaattgggaagacaaaaacataatagcacgaagagtcgggcacgaaaagcccgatctctctctctctctctcgtgcgcgcaggggcgtgtgggtgcacgacgacgaggacggaggggggaagggaggcataaacggatcgatcccccatcgcacatgcgggtacgagcattatctgctgtgtctggtcctttatcatatcgctacccgcccgccccccgcccccctcccccccccccccccgcggctcctgtcactgtcgttcctgcgactccccacacacccgcgcaacgctcatgtcacgaagagaaaagtagaaggcgtggcgatgcgttgcgcggccccctgtccgctggcatgcagacgtcgagccgtggaacggatggtagcgagagacaacgcggcgatgcaggaaaggagatttactgcaggacgtctacacacgcgcgcacaccactgcgaatggcaccgtgctgaggaaaattgggggggagggcgcacgggggcggggcaggaaacggttggatcagcagcactctcaacttgtgtccgtattgcgaaggagggagaggagcctgcccgtattatgggcgctgaaacgtcggaaccacctatgaatcccacttctgcgtcgcggaggcgtactgcttccgaccacctccgcagctcacgcgcgtcgagctccctccctttccccttctttccgttgtgtgtgtgtgtgtgtgtgtgtcttgtcacgatgcatggccatctctcctccaaccctccacgccttcctctcccccgcccatcaaacgcgctacggccacaaccatttcttcaagtatcacatccaccaccactcttacccacctaccctcttcgactctgacacagccactgacgccctctccgcctctctcgctcgctgcacattgactctccacagccccccctccctcgcacagccagccccacccacccacccacccacccaccgctctacacacctccacagcagccggatccaccgcatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgaccgactagttctagttctaggggccgaattcagatcctcgtgtgagcgttcgcggaatcggtcgctcgtgtttatgcccgtcttggtgttgtgctcgcaaggcggtgcagcaggataccgtcgccctcctctctccttgcttctctgttcttcaattcgcgatctcacagaggccggctgtgcacgcccttcctcaccctccttttcccacctctcggccaccggtcggctccgttccgtctgccgtcgagaagggacgggcatgtgcagctcctccctttctctcgcgcgcgcatcttctcttgcttgtggcactcacgctcatgcgtcaaggcggccccacgccgagcccctgcgctcccttccctcttgcgcatccgtagcgcggatgccgtcgatgcgcaaggccggcatgaaggagcgcgtgccctcaagagggcacactatcatgccctacgtgggccacgcagcgatgaggccggcttcggcggagatgcgtcacgcacgtgccagatgatgcgctacgccttccttgacttgcgcccccctctcttcctccgtctctcactctctctctctcacacacacacacacacacacacacacacaaagctccggttcgtccggccgtaacgccttttcaactcacggcctctaggaatgaaggagggtagttcgggggagaacgtactggggcgtcagaggtgaaattcttagaccgcaccaagacgaactacagcgaaggcattcttcaaggataccttcctcaatcaagaaccaaagtgtggagatcgaagatgattagagaccattgtagtccacactgcaaacgatgacacccatgaattggggatcttatgggccggcctgcggcagggtttaccctgtgtcagcaccgcgcccgcttttaccaacttacgtatcttttctattcggcctttaccggccacccacgggaatatcctcagcacgttttctgttttttcacgcgaaagctttgaggttacagtctcaggggggagtacgttcgcaagagtgaaacttaaagaaattgacggaatggcaccacaagacgtggagcgtgcggtttaatttgactcaacacggggaactttaccagatccggacaggatgaggattgacagattgagtgttctttctcgattccctgaatggtggtgcatggccgcttttggtcggtggagtgatttgtttggttgattccgtcaacggacgagatccaagctgcccagtagaattcagaattgcccatagaatagcaaactcatcggcgggttttacccaacggtgggccgcattcggtcgaattcttctctgcgggattcctttgtaattgcacaaggtgaaattttgggcaacagcaggtctgtgatgctcctcaatgttctgggcgacacgcgcactacaatgtcagtgagaacaagaaaaacgacttttgtcgaacctacttgatcaaaagagtggggaaaccccggaatcacatagacccacttgggaccgaggattgcaattattggtcgcgcaacgaggaatgtctcgtaggcgcagctcatcaaactgtgccgattacgtccctgccatttgtacacaccgcccgtcgttgtttccgatgatggtgcaatacaggtgatcggacaggcggtgttttatccgcccgaaagttcaccgatatttaaatatcccaatggcgcgccgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 92 - protein, 722 aa, Mus musculus
  UDP-GlcNAc 2-epimerase/ N-acetylmannosamine kinase Mus musculus mGNE Q91WG8.1TBA
MEKNGNNRKLRVCVATCNRADYSKLAPIMFGIKTEPAFFELDVVVLGSHLIDDYGNTYRMIEQDDFDINTRLHTIVRGEDEAAMVESVGLALVKLPDVLNRLKPDIMIVHGDRFDALALATSAALMNIRILHIEGGEVSGTIDDSIRHAITKLAHYHVCCTRSAEQHLISMCEDHDRILLAGCPSYDKLLSAKNKDYMSIIRMWLGDDVKCKDYIVALQHPVTTDIKHSIKMFELTLDALISFNKRTLVLFPNIDAGSKEMVRVMRKKGIEHHPNFRAVKHVPFDQFIQLVAHAGCMIGNSSCGVREVGAFGTPVINLGTRQIGRETGENVLHVRDADTQDKILQALHLQFGKQYPCSKIYGDGNAVPRILKFLKSIDLQEPLQKKFCFPPVKENISQDIDHILETLSALAVDLGGTNLRVAIVSMKGEIVKKYTQFNPKTYEERISLILQMCVEAAAEAVKLNCRILGVGISTGGRVNPQEGVVLHSTKLIQEWNSVDLRTPLSDTLHLPVWVDNDGNCAAMAERKFGQGKGQENFVTLITGTGIGGGIIHQHELIHGSSFCAAELGHLVVSLDGPDCSCGSHGCIEAYASGMALQREAKKLHDEDLLLVEGMSVPKDEAVGALHLIQAAKLGNVKAQSILRTAGTALGLGVVNILHTMNPSLVILSGVLASHYIHIVKDVIRQQALSSVQDVDVVVSDLVDPALLGAASMVLDYTTRRIH

SEQ ID NO: 93 - protein, 722 aa, Homo sapiens
  UDP-N- GlcNAc 2-epimerase/N-acetylmannosamine kinase Homo sapiens hGNE Q9Y223.1
MEKNGNNRKLRVCVATCNRADYSKLAPIMFGIKTEPEFFELDVVVLGSHLIDDYGNTYRMIEQDDFDINTRLHTIVRGEDEAAMVESVGLALVKLPDVLNRLKPDIMIVHGDRFDALALATSAALMNIRILHIEGGEVSGTIDDSIRHAITKLAHYHVCCTRSAEQHLISMCEDHDRILLAGCPSYDKLLSAKNKDYMSIIRMWLGDDVKSKDYIVALQHPVTTDIKHSIKMFELTLDALISFNKRTLVLFPNIDAGSKEMVRVMRKKGIEHHPNFRAVKHVPFDQFIQLVAHAGCMIGNSSCGVREVGAFGTPVINLGTRQIGRETGENVLHVRDADTQDKILQALHLQFGKQYPCSKIYGDGNAVPRILKFLKSIDLQEPLQKKFCFPPVKENISQDIDHILETLSALAVDLGGTNLRVAIVSMKGEIVKKYTQFNPKTYEERINLILQMCVEAAAEAVKLNCRILGVGISTGGRVNPREGIVLHSTKLIQEWNSVDLRTPLSDTLHLPVWVDNDGNCAALAERKFGQGKGLENFVTLITGTGIGGGIIHQHELIHGSSFCAAELGHLVVSLDGPDCSCGSHGCIEAYASGMALQREAKKLHDEDLLLVEGMSVPKDEAVGALHLIQAAKLGNAKAQSILRTAGTALGLGVVNILHTMNPSLVILSGVLASHYIHIVKDVIRQQALSSVQDVDVVVSDLVDPALLGAASMVLDYTTRRIY

SEQ ID NO: 94 - protein, 722 aa, Rattus norvegicus
  UDP-N- GlcNAc 2-epimerase/N-acetylmannosamine kinase Rattus norvegicus rGNE/ MNK O35826
MEKNGNNRKLRVCVATCNRADYSKLAPIMFGIKTEPAFFELDVVVLGSHLIDDYGNTYRMIEQDDFDINTRLHTIVRGEDEAAMVESVGLALVKLPDVLNRLKPDIMIVHGDRFDALALATSAALMNIRILHIEGGEVSGTIDDSIRHAITKLAHYHVCCTRSAEQHLISMCEDHDRILLAGCPSYDKLLSAKNKDYMSIIRMWLGDDVKCKDYIVALQHPVTTDIKHSIKMFELTLDALISFNKRTLVLFPNIDAGSKEMVRVMRKKGIEHHPNFRAVKHVPFDQFIQLVAHAGCMIGNSSCGVREVGAFGTPVINLGTRQIGRETGENVLHVRDADTQDKILQALHLQFGKQYPCSKIYGDGNAVPRILKFLKSIDLQEPLQKKFCFPPVKENISQDIDHILETLSALAVDLGGTNLRVAIVSMKGEIVKKYTQFNPKTYEERISLILQMCVEAAAEAVKLNCRILGVGISTGGRVNPQEGVVLHSTKLIQEWNSVDLRTPLSDTLHLPVWVDNDGNCAAMAERKFGQGKGQENFVTLITGTGIGGGIIHQHELIHGSSFCAAELGHLVVSLDGPDCSCGSHGCIEAYASGMALQREAKKLHDEDLLLVEGMSVPKDEAVGALHLIQAAKLGNVKAQSILRTAGTALGLGVVNILHTMNPSLVILSGVLASHYIHIVRDVIRQQALSSVQDVDVVVSDLVDPALLGAASMVLDYTTRRIH

SEQ ID NO: 95 - protein, 722 aa, Artificial Sequence
  UDP-N- GlcNAc 2-epimerase/N-acetylmannosamine kinase with point mutations from sialuria patient's GNE/MNK Rattus norvegicus GNE/MNK-R263L-R266Q mutant
MEKNGNNRKLRVCVATCNRADYSKLAPIMFGIKTEPAFFELDVVVLGSHLIDDYGNTYRMIEQDDFDINTRLHTIVRGEDEAAMVESVGLALVKLPDVLNRLKPDIMIVHGDRFDALALATSAALMNIRILHIEGGEVSGTIDDSIRHAITKLAHYHVCCTRSAEQHLISMCEDHDRILLAGCPSYDKLLSAKNKDYMSIIRMWLGDDVKCKDYIVALQHPVTTDIKHSIKMFELTLDALISFNKRTLVLFPNIDAGSKEMVLVMQKKGIEHHPNFRAVKHVPFDQFIQLVAHAGCMIGNSSCGVREVGAFGTPVINLGTRQIGRETGENVLHVRDADTQDKILQALHLQFGKQYPCSKIYGDGNAVPRILKFLKSIDLQEPLQKKFCFPPVKENISQDIDHILETLSALAVDLGGTNLRVAIVSMKGEIVKKYTQFNPKTYEERISLILQMCVEAAAEAVKLNCRILGVGISTGGRVNPQEGVVLHSTKLIQEWNSVDLRTPLSDTLHLPVWVDNDGNCAAMAERKFGQGKGQENFVTLITGTGIGGGIIHQHELIHGSSFCAAELGHLVVSLDGPDCSCGSHGCIEAYASGMALQREAKKLHDEDLLLVEGMSVPKDEAVGALHLIQAAKLGNVKAQSILRTAGTALGLGVVNILHTMNPSLVILSGVLASHYIHIVRDVIRQQALSSVQDVDVVVSDLVDPALLGAASMVLDYTTRRIH

SEQ ID NO: 96 - protein, 359 aa, Homo sapiens
  N-acetylneuraminic acid phosphate synthase Homo sapiens hNANS Q9NR45.2TBA
MPLELELCPGRWVGGQHPCFIIAEIGQNHQGDLDVAKRMIRMAKECGADCAKFQKSELEFKFNRKALERPYTSKHSWGKTYGEHKRHLEFSHDQYRELQRYAEEVGIFFTASGMDEMAVEFLHELNVPFFKVGSGDTNNFPYLEKTAKKGRPMVISSGMQSMDTMKQVYQIVKPLNPNFCFLQCTSAYPLQPEDVNLRVISEYQKLFPDIPIGYSGHETGIAISVAAVALGAKVLERHITLDKTWKGSDHSASLEPGELAELVRSVRLVERALGSPTKQLLPCEMACNEKLGKSVVAKVKIPEGTILTMDMLTVKVGEPKGYPPEDIFNLVGKKVLVTVEEDDTIMEELVDNHGKKIKS

SEQ ID NO: 97 - protein, 248 aa, Homo sapiens
  Neu5Ac-9-P phosphatase Homo sapiens hNANP Q8TBE9.1
MGLSRVRAVFFDLDNTLIDTAGASRRGMLEVIKLLQSKYHYKEEAEIICDKVQVKLSKECFHPYNTCITDLRTSHWEEAIQETKGGAANRKLAEECYFLWKSTRLQHMTLAEDVKAMLTELRKEVRLLLLTNGDRQTQREKIEACACQSYFDAVVVGGEQREEKPAPSIFYYCCNLLGVQPGDCVMVGDTLETDIQGGLNAGLKATVWINKNGIVPLKSSPVPHYMVSSVLELPALLQSIDCKVSMST

SEQ ID NO: 98 - protein, 434 aa, Homo sapiens
  CMP-sialic acid synthetase Homo sapiens hCMAS Q8NFW8.2
MDSVEKGAATSVSNPRGRPSRGRPPKLQRNSRGGQGRGVEKPPHLAALILARGGSKGIPLKNIKHLAGVPLIGWVLRAALDSGAFQSVWVSTDHDEIENVAKQFGAQVHRRSSEVSKDSSTSLDAIIEFLNYHNEVDIVGNIQATSPCLHPTDLQKVAEMIREEGYDSVFSVVRRHQFRWSEIQKGVREVTEPLNLNPAKRPRRQDWDGELYENGSFYFAKRHLIEMGYLQGGKMAYYEMRAEHSVDIDVDIDWPIAEQRVLRYGYFGKEKLKEIKLLVCNIDGCLTNGHIYVSGDQKEIISYDVKDAIGISLLKKSGIEVRLISERACSKQTLSSLKLDCKMEVSVSDKLAVVDEWRKEMGLCWKEVAYLGNEVSDEECLKRVGLSGAPADACSTAQKAVGYICKCNGGRGAIREFAEHICLLMEKVNNSCQK

SEQ ID NO: 99 - protein, 337 aa, Homo sapiens
  CMP-Neu5Ac transporter Homo sapiens hCST P78382.1
MAAPRDNVTLLFKLYCLAVMTLMAAVYTIALRYTRTSDKELYFSTTAVCITEVIKLLLSVGILAKETGSLGRFKASLRENVLGSPKELLKLSVPSLVYAVQNNMAFLALSNLDAAVYQVTYQLKIPCTALCTVLMLNRTLSKLQWVSVFMLCAGVTLVQWKPAQATKVVVEQNPLLGFGAIAIAVLCSGFAGVYFEKVLKSSDTSLWVRNIQMYLSGIIVTLAGVYLSDGAEIKEKGFFYGYTYYVWFVIFLASVGGLYTSVVVKYTDNIMKGFSAAAAIVLSTIASVMLFGLQITLTFALGTLLVCVSIYLYGLPRQDTTSIQQGETASKERVIGV

SEQ ID NO: 100 - protein, 336 aa, Mus musculus
  CMP-sialic acid transporter Mus musculus  mCST Q61420.2
MAPARENVSLFFKLYCLTVMTLVAAAYTVALRYTRTTAEELYFSTTAVCITEVIKLLISVGLLAKETGSLGRFKASLSENVLGSPKELAKLSVPSLVYAVQNNMAFLALSNLDAAVYQVTYQLKIPCTALCTVLMLNRTLSKLQWISVFMLCGGVTLVQWKPAQATKVVVAQNPLLGFGAIAIAVLCSGFAGVYFEKVLKSSDTSLWVRNIQMYLSGIVVTLAGTYLSDGAEIQEKGFFYGYTYYVWFVIFLASVGGLYTSVVVKYTDNIMKGFSAAAAIVLSTIASVLLFGLQITLSFALGALLVCVSIYLYGLPRQDTTSIQQEATSKERIIGV

SEQ ID NO: 101 - protein, 228 aa, Neisseria meningitidis
  CMP-sialic acid synthetase Neisseria meningitidis neuA P0A0Z8TBA
MEKQNIAVILARQNSKGLPLKNLRKMNGISLLGHTINAAISSKCFDRIIVSTDGGLIAEEAKNFGVEVVLRPAELASDTASSISGVIHALETIGSNSGTVTLLQPTSPLRTGAHIREAFSLFDEKIKGSVVSACPMEHHPLKTLLQINNGEYAPMRHLSDLEQPRQQLPQAFRPNGAIYINDTASLIANNCFFIAPTKLYIMSHQDSIDIDTELDLQQAENILNHKES

SEQ ID NO: 102 - protein, 377 aa, Neisseria meningitidis
  UDP-N-acetylglucosamine 2-epimerase Neisseria meningitidis neuC H2VFI5
MKRILCITGTRADFGKLKPLLAYIENHPDLELHLIVTGMHMMKTYGRTYKEVTRENYQHTYLFSNQIQGEPMGAVLGNTITFISRLSDEIEPDMVMIHGDRLEALAGAAVGALSSRLVCHIEGGELSGTVDDSIRHSISKLSHIHLVANEQAVTRLVQMGEKRKHIHIIGSPDLDVMASSTLPSLEEVKEYYGLPYENYGISMFHPVTTEAHLMPQYAAQYFKALELSGQNIISIYPNNDTGTESILQELLKYQSDKFIAFPSIRFEYFLVLLKHAKFMVGNSSAGIREAPLYGVPSIDVGTRQSNRHMGKSIIHTDYETKNIFDAIQQACSLGKFEADDTFNGGDTRTSTERFAEVINNPETWNVSAQKRFIDLNL

SEQ ID NO: 103 - protein, 349 aa, Neisseria meningitidis
  CMP-sialic acid synthase Neisseria meningitidis neuB Q7DDU0
MQNNNEFKIGNRSVGYNHEPLIICEIGINHEGSLKTAFEMVDAAYNAGAEVVKHQTHIVEDEMSDEAKQVIPGNADVSIYEIMERCALNEEDEIKLKEYVESKGMIFISTPFSRAAALRLQRMDIPAYKIGSGECNNYPLIKLVASFGKPIILSTGMNSIESIKKSVEIIREAGVPYALLHCTNIYPTPYEDVRLGGMNDLSEAFPDAIIGLSDHTLDNYACLGAVALGGSILERHFTDRMDRPGPDIVCSMNPDTFKELKQGAHALKLARGGKKDTIIAGEKPTKDFAFASVVADKDIKKGELLSGDNLWVKRPGNGDFSVNEYETLFGKVAACNIRKGAQIKKTDIE

SEQ ID NO: 104 - protein, 372 aa, Campylobacter jejuni
  N -acetylglucosamine-6-phosphate 2-epimerase Campylobacter jejuni GNPE A1A4A1
MKKILFITGTRADYSKIKSLMYRVQNSSEFELYIFATGMHLSKNFGYTVKELYKNGFKNIYEFINYDKYYQTDKALATTIDGFSRYVNELKPDLIVVHGDRIEPLAAAIVGALNNILVAHIEGGEISGTIDDSLRHAISKLAHIHLVNDEFAKRRLIQLGEDEKSIFIIGSPDLELLNDNKISLNEAKKYYDINYENYALLMFHPVTTEITSIKNQADNLVKALIQSNKNYIVIYPNNDLGFELILQSYEELKNNPRFKLFSSLRFEYFITLLKNADFIIGNSSCILKEALYLKTAGILVGSRQNGRLGNENTLKVNANSDEILKAINTIHKKQDLFSAKLEILDSSKLFFEYLLSGEFFKLSTQKVFKDIK

SEQ ID NO: 105 - protein, 312 aa, Corynebacterium glutamicum ATCC13032
  N-acetylneuraminic acid lyase Corynebacterium glutamicum CgNal Q8NMD2
MASATFTGVIPPVMTPLHADGSVDVESLRKLVDHLINGGVDGLFALGSSGEAAFLTRAQRKLALTTIIEHTAGRVPVTAGVIETTTARVIELVEDALEAGAEGLVATAPFYTRTHDVEIEEHFRKIHAAAPELPLFAYNIPVSVHSNLNPVMLLTLAKDGVLAGTKDSSGNDGAIRSLIEARDDAGLTEQFKILTGSETTVDFAYLAGADGVVPGLGNVDPAAYAALAKLCLDGKWAEAAALQKRINHLFHIVFVGDTSHMSGSSAGLGGFKTALAHLGIIESNAMAVPHQSLSDEETARIHAIVDEFLYTA

SEQ ID NO: 106 - DNA, 9337 bp, Artificial Sequence; identical to SEQ ID NO: 64
  pLMTB5829 (ssu::SfGnT-I-3HA-Strep native)

SEQ ID NO: 107 - DNA, 10137 bp, Artificial Sequence; identical to SEQ ID NO: 87
  pLMTB6173 (ssu::Stt3A_d90_SfGnT-I-Strep)

SEQ ID NO: 108 - protein, 176 aa, homo sapiens
  human EPO peptide
APPRLICDSRVLERYLLEAKEAENITTGCAEHCSLNENITVPDTKVNFYAWKRMEVGQQAVEVWQGLALLSEAVLRGQALLVNSSQPWEPLQLHVDKAVSGLRSLTTLLRALGAQKEAISPPDAASAAPLRTITADTFRKLFRVYSNFLRGKLKLYTGEACRTGDAGAWSHPQFEK

SEQ ID NO: 109 - protein, 25 aa, Artificial Sequence
  rhEPO peptide sequence (N-glycosylation N24 and N38 sites)
EAENITTGCAEHCSLNENITVPDTK

SEQ ID NO: 110 - protein, 636 aa, L. tarentolae
  invertase
MIASSVRHAVILLLVAVAMMAAAVIAKDGVPYEPIYHIRPPKNWINDPNGPYRDPVTGKIHLYMQYNPNGPLWGDIAWYHVTSEDYVKWTRPESPVAVWADKWYDRWGAYSGTMMNNNLKEPVMVYTCTEPENIQRQCIANPPKSDLKGKRTLNTLVKSPLNVIMSEDMIPGIVAMENFRDPTEWWQDPANPNRWLIAFVARIKDDEGDNAHVIVFSTEDPSFQSGYSFSHSLYVYKYDLSHMFECPDFFTLKQGGEHYLKVSTMPSHRDYIIYGSYELNTTSRQYVFVEDPERSFTFIDYGPFYASKTFHDPILNRRTIWGWTNDELSDEQIIANGWSGVQNMLRTMVYDATEKKIKTHPVPEIKGLRVDKLIDVRDIAVTETPKLVIANSTLYHEIVARFTLADPATFSATATYASDSDVPEVGVMIRVNANLSQYTTVSVRMPSGGPNASPNTEQTETYPAIKVFDSTSAANCSAECNKMRLCESYTWKSDTCNLYWKINPMVSAADATSGTVREPLLYLGRTKSGTIGSTAPLHGRAPFAVATPNGFELHIFVDDSVVEVFKDDGLETLTGRLYIDNSADTTGIAVYARNAGDVTANIEVYTMDSIWAPPKRSAVKNFTDSLYNLLDTLVDA

SEQ ID NO: 111 - protein, 242 aa, Artificial Sequence
  Light Chain of Rituximab_LMTB (p5026)
MIAGSVRRGVILLLVAVAVATMAAAVSAAQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 112 - protein, 480 aa, Artificial Sequence
  Heavy Chain of Rituximab_LMTB (p5026)
MIAGSVRRGVILLLVAVAVATMAAAVSAAQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 113 - protein, 1540 aa, L. tarentolae
  LTAR_020007600.1
MKRRTGERYSDETPLRMISSGCGNDVADGLVKVPAAPFLEAYDDHYDHQAESVDDEAEVTRVGTSAEFSFSSPSLPAASLSRRWQSCLRCTSVNPSSMGSLCAARQGWTRWHSPRPVRSVVSRLSSLASASSSYASLVCAASGHLFGTNRWQRVRGGTEKRAASDAHVSSGIGRRNSSGNQRCHETRAASLIQRLLRAAFIGVSLVVLLALLGVLLDLAVDVAIHALGDNLGAAVLAELEGVQAPWLDCDCAGKVPMGDVAFADTVPPEVAQVLERHLDVVTVATDRGCHVCAPSAVRIGALGEHVVGGDDDEGSLSHDARLRPVSRLVRATQALAAHLYDTFADVAAVLYPRLTMVVMWCRHAYDTSIEQHRMSQLWQRQNRGVAGGAVTEVLTGVPSSPPLPPMPLLGLPDGPWANHYAEPRTMAVPYKSSFLVVADHKEARLACAARAPLSRLFLHRQALPWMSITAASHRTREEWRADPKGRASLLPFPVPPSEGEQQRLRDTSHAAPHYLDGGRDVPEISIAVTDQTKDFYSYLCADVPNVSAAGAVYHLDPLRALLLKGSDASAKNQSMAASQCTGCVFHCVHPRLLRRHRRHAEPADTKGPTEDKDEDESPAEPLSWDVSLEDVDAGHVRVATGSSSSAAAADDDDDDEDDDENATTVTVTREDLFTCKVLNPSRKRDTSAPGKNGAHDDTNRVLLLSVDVWLSHAGGGTPLFFSNNTHTSPRLHRDNDSTDASLVRLLPLHTAAIYGESLQSFPGYAMRPSYWLQYDAVYLQNTIRRPDRLSSLLAAASRRRGSGVAKPKTQFSTWTVTHYYMRDFQLIVYLNQLRRQQGAQANTSVSVTAQDAPVALPWTPPPNGGAARRATATGALARLAFEVLHGADPLLLPMHGENLHVPPLPVSWRPPTPKEWGRGRPGSAEEMRLPFSGATGRIPAIAAAISHCWHARMWWLSELSRYYPVHNYGRCAIPSPAPLPGDATPTRGIPQRARFPFPSECSAKALRRHHESALASMQATYGRVGSDGPGGATRPMTHVGRDHELRCVFRKYRYVLAFENTIEDDYVTEKVYNALLSGALPLYIGAMNIADYVPHTPGRVPSRGLSVIPVLQMFPILNETAWRMEERRVLDLLEEDEAVSRHVLRSHAEVLRARSAATQCANRTTSIPAKRSDSAIRMAEIVATALEEVAAQTPHAVANQHYLLYTSNETAVAAGQTADKNKLPKSAPHGTDYLGNCSSAFGAAVPSFTSPAGVWPPESALEHTSLPEQETTQFTDQSGGDAARRTAAQSPSTDAYCVGYGQQEYLRRVHADVREAAEAAARMPARSSSSTETLRTTLTSVPAPRLDARNASHRYFAAPVNESRTRRRRVRYKAVEDWSLTANTAWGFSEDVNSTARLCKSAATTAHLPRAVQRFPEASGRTPAQQDYTAEGDMYSRYFYRRSVPPTPAYERELAATAASAGRRNASSPPPMNGFAQLAAYLRSLDADPTLVEDAGFFDWWRAERMEDYSDAFLEKLYTPHPVCSICAAALEKKEAQTRT

SEQ ID NO: 114 - protein, 636 aa, L. tarentolae; identical to SEQ ID NO: 110
  LTAR_040008100.1

SEQ ID NO: 115 - protein, 1581 aa, L. tarentolae
  LTAR_070011100.1
MDSRGGQLRRGLLWRIAVAIVVLALLESITTQAALAAVEENGPPQPRDARGRETIESKTDAPATQEEDPLTAPDGVLHYDNGALKTSASMRNQQEHYGSATESSTELHTETLPDRAEESDTSSSSALSSEAALEDSAVAERQWFEPPPPKNVPSRALPNGSQYSSEGGGWQHDLQEQATESTTTIPSSIYTDDTGAPYTDDVHAAASPTETATFSSSGVGVTEVSVDAVSEGGVSAPVPPPEDLAAPAQSDQWSALDAPAASTPAWEEGGSSASQQPQAEMQEPYNVSQHPAGEISDSATGVTEVGGACPSALRDRASDTAQTEDRLPLKGDSQEPHEDQQGASAHCDAHTTAQGNPAWKTGDTQQGAVAGAAQQEASSPSTVESTPTALEAPTTWGTSEEELHQARATSAHEGVRGNELSDSFSAPEARGQPASAHHSMHQQWAQDETGINGATHGLGGATADDEVHGGPAGASLEEMRPAEAPAPEVEEATAEENASSAETATHPATVEGPGRTYFPAPHIDNAPSHAVDEAAVVAEQTLAERHVNDTDQDSSDTSISSEENSKGAAYTQPTEGQATGGNVNPDVDIDVIRHGEGAMESEEAATHFGERSDGTTTAGITVTGEAESAAREAAVDLDEADDDGLGVNEEQLASSSSASDTIDAPATVPPRVIVTMNTMRCALNPASVATCIVLPLLPCPGGALRGRECHPFRRACPVEPYGHARLNWLLGVLHTYGVGVPRSERDALMYYSFAAMEAVPEAHMALGYRYKHGLGVAASCESALAHYREAADAVAMTYGGTAASAGGGTEPMTAGAKTVGSSKGERGWPMSFFAYRDDAAVSDMRKQRRLDLISLKYQADMGNVEALLTLGYLLLKGDYQVARDGRRAAACFETAAGKGSARAHGALGQLYMAGDPSTNPPLPPDMQRALHHFRLGALQDDALSLNGIGFLHAIGFLSQDKQHRAPGSDSRNATKVPDEDGEAAASPLKGPPDFSTAAHYFYRSHCAEGLYNLGVLFLHGRGVTADKKQARHLFEKAAKQGSVLAQWQLANMLSEATEDGNTLTTAECERALALYQRTASFGTWQHRAPAHRHSGGGSDVGVDNADVQKQPRRHDQRKKMGVYGDHDAQSWGETNTSRTPSQSGSGSEDDGDAADRLDGFVRPRSEAEYQVLLTGILDRLHAAEESLVSSDEDEGAITTSLASFVELLSLAETGDAAASWLAVQYVDDHLEVADTRVMDDKHLDKSGAVPLLWPLTSVAGEASQYMSGKAAASELLYYLLQRTVLHHTHTHTTLGAAYLRLGNFFYYGESPQYGVDMERALTYYRVAGDQHHSAQALFNVGFMYQLGLHKAPRVTRVVGGMSAQEVMERPELLRHYTGASVGAEWKVHSSPPEYLQASPAFYLVLKAAANAWNHASTDPMAKGVDIYLAWRYYTASLRQEGRGWMAVQFAVAVLNMQWSLRHFRVSWLPPKLESFASLITPPPASADSASSMARAEASEGGVTLSTSAGGAHRAHQDIRDTLSGLLVTLTTALRVMWSYFTENARHASGMMLSWYKPLEDAILYGAISVVVIGLLVRHHVA

SEQ ID NO: 116 - protein, 533 aa, L. tarentolae
  LTAR_090021500.1
TKMQRQRIRHHLRFVDRYIVLAVLGVVVYILVVSLIAESLAIGVRDRAKAKVSTAEVRHAAHTIPDEVFWPHRWPAAPVAEVRIIKEAMEYVTTSLTKVMPFTKHLPEAQLAAGDLVLLTGVSTDWAPTAKELKTMTEAVLSTAGSAASSETLTAVREALESTAVVWSIKGKTAEADEVRKLLKDMPATPAPAAAAAASSWSSFTREMWVRFATGSASSTPDSITEAYNSLRTASESYWHPGEQAAAVPPLHNSRLLPLRAGTYDAVVPFMRLLLQLWVLGGRRDSEKPLLEAYDAAVMSIVQDLFYTRTVTAGAQTMNFTFVGSRAEALVPVATPRMCALAGVLAQGIRYGAHRYPTRPSSARYSEDNVLQASEALATSCFQLYADPAGRKLRSAVYVTNSGPVPGYTRAGDDGVNASLRSSYCDIPAILLESFYELYQTTHDAMYGLWSLLVMRQDTSDHCGLRKTDVSSATPWRRHIRELRTLWLLFHRMDCLVYSRSRGSRGICDLAATTIVSPVTGHLVSVPNTPAAL

SEQ ID NO: 117 - protein, 718 aa, L. tarentolae
  LTAR_100006700.1
MAASTCERGWLQRFACASPIRNTLSRIFSAPMEARATGGRLRGSTRRAVAVFFTAVFAVVFLTVYEVGIGVANPHQSLHTQLTENAVKNGEAQLANCRYVNANLKGSGGVDAAQAMAEVRRQREELMSMLELERQRVSSARSRLQACEDALAKDLRLSSGVADHHVTERSRLLEEKQRSLEEWHTMRSAGPLRAVESRRSSDIRALQAALFHEMRAYKTADNDVAKEETCAKSSAKFSVVFDIGSTGNRVHVYKYRVTPLRHIAAAARFELSDLDLVEELFELNHKALSELENPVQEAPDALRVLFLKAKNFVPAELHACTPVEFKATAGLRMLGAEKATDILAAIRARYLNETFWLCGNSPVRILDAREEGPMAWLTVNYLLGAFSRSTTKAATSTVAVIDLGGGSTQIVFEPGESVFREMGTDFRYSATLGSRSVRAYQHSYEGYGLHAATKELLFHIQGKRQENPGGATPTTCTATRTTTTAPASSDDKAPSVRDLLGNVAADAGDARDDIATKSVPPPQRDAEAVEAFPCFAVGYEDPLGVRNIRRNNAEEPVVHPSFQSCMNLFRDRLLKPVGLTCEAANCGIAGVMQPSLANFTGEIYMFSFIFDLLSLANSSLVPAGAAVSKEKFEIKLPDLARIAEGHCAAFSLTRIAEAAAKGGLGSLKPQYECMYYSYVYALLRYGYGVPEDRVLHVVKKIRGYEASWSLGASLLSLT

SEQ ID NO: 118 - protein, 584 aa, L. tarentolae
  LTAR_100010400.1
MSVDSSSTHRRRSVAARLVRLAAASAAAAVALATAAAWAHGDAAQHRCIHDSMQARVVQSVAEQRLDPSRVAPVGLPYVAVDADDTAAERSSGVHTKQWGTPRIAVFTYDFTDEHYFCSRVGQNVSMRNGNFAICTADDVLTYEKRDIIRDFIIPQALQLHTRRLKVQQVQDTWKVKDMVGVICGSFNVPSLHTTDGLRDKDFVIYVASVPAKRGVMAWATSCQVFSDGRPAVGVINISPAKIVPKYYKYLIRTAAHEIAHALGFSKRYFKSAGILTRVPNVRGKDFKVPVINSTTVVAKVREHYGCNTLEHLELEDQGGAGSAESHIKMRNAQDELMVSAAAAGYYTALTMAVFQDLGFYQVDFSRAEAMSWGKDAGCAFLSEKCMEKGVTKWPSMFCSGAEEGLRCPSNRMGLGYCPVTNEKGLPEYFQYFADPSLSGISSFMDYCPIMVHYADGSCAQDASKAKPWMKTFNVFSKTARCLDGDFRTANGSQSASYRALCADVKCDTLRRTYTIQVNGGTYVKCVPGTQRELINLSTSFQKGGYITCPPYEEVCQRNVLPPEDISNAATGHRGTVPVPLESL

SEQ ID NO: 119 - protein, 397 aa, L. tarentolae
  LTAR_110005100.1
MRHRHGVLAAEPEWSAAHTTISRHLANVDFFAKPKEDYRREQTQWGAVVSLCTVCVITFLVLWEGIAYITGRDAYDTDVSLDKGLSEDMPIHVDVLFPFLPCNRLSIDVVDSTGRKEFNYTGTIHKLPTALDGTVLYKGGLKELENEIENRVPGTGSNCRPCPSSAFDGATAEVLSAAASKCCNTCESVLDLYKELGKGIPDTEYIPQCLEQLYERSSGCNVVGSLELKKVPVVLIFGPRRTGEYYSLKDVVRLDTSHLIRKLRIGDESVERFSKNGVAEPLSGHKSSSLDYSETRYLVKVVPTTYRKRKVRDAKASTYEYSAQWSRRSIVVGFAGAVPAVYFEFEPAAIQVNNIFERQPFPHFVVQLCGIAGGLFVVLGFIDGAVHWFLGFGKRWH

SEQ ID NO: 120 - protein, 1703 aa, L. tarentolae
  LTAR_110005600.1
MDRFLKTSSSEATQAKEEVELLQQKMKTMNEVVAVLQTQLNDEKEKYALLLTKTSTWKEKVKTLTQSDRARIAELESQLAAYHVAREANGGELTPEIRAAVQASLGEIMAKHAEDMDACKQQVSALQTTLSTKEIEIAELMQELEAVKAIHLESQQRFAEEMQSLTDHQEKEVAQLRCNADSLQELDELKSRFREQQSQIFLLENHSQQSEQMISALQKDLSSSTEKNQLLSGEVRTLQESLATLKQKQAIWKEKVMQMKAKDDEAIKQLKSELALTRESSLERNRSPSPRVRPLPDFQPRTSHAEATLNSEDTSASTLPPSSPEEHVYKLPLHFEDEPITPQQFQEKLDTWKYKVTQQKMHDIRKIETLQSECEQLRHQLAAGADEQAQQRDTLRAQLAAAERDRDNAVQQAQQHAEELEQLRHQLAAGADEQAQERDTLRAQLAAAERDRDNAVQQAQQHAEELEQLRHQLAAGADEQAQERDTLRAQLAAAERDRDNAVQQAQQHAEELEQLRHQLAAGADEQAQERDTLRAQLAAAERDRDNAVQQAQQHAEELEQLRHQLAAGADEQAQERDTLRAQLAAAERDRDNAVQQAQQHAEELEQLRHQLAAGADEQAQQRDTLRAQLAAAERDRDNAVQQAQQHAEELEQLRHQLAAGADEQAQERDTLRAQLAAAERDRDNAVQQAQQHAEELEQLRHQLAAGADEQAQERDTLRAQLAAAERDRDNAVQQAQQHAEELEQLRHQLAAGADEQAQERDTLRAQLAAAERDRDNAVQQAQQHAEELEQLRHQLAAGADEQAQERDTLRAQLAAAERDRDNAVQQAQQHAEELEQLRHQLAAGADEQAQERDTLRAQLAAAERDRDNAVQQAQQHAEELEQLRHQLAAGADEQAQERDTLRAQLAAAERDRDNAVQQAQQHAEELEQLRHQLAAGADEQAQERDTLRAQLAAAERDRDNAVQQAQQHAEELEQLRHQLAAGADEQAQERDTLRAQLAAAERDRDNAVQQAQQHAEELEQLRHQLAAGADEQAQERDTLRAQLAAAERDRDNAVQQAQQHAEELEQLRHQLAAGADEQAQERDTLRAQLAAAERDRDNAVQQAQQHAEELEQLRHQLAAGADEQAQERDTLRAQLAAAERDRDNAVQQAQQHAEELEQLRHQLAAGADEQAQERDTLRAQLAAAERDRDNAVQQAQQHAEELEQLRHQLAAGADEQAQERDTLRAQLAAAERDRDNAVQQAQQHAEELEQLRHQLAAGADEQAQQRDTLRAQLAAAERDRDNAVQQAQQHAEELEQLRHQLAAGADEQAQERDTLRAQLAAAERDRDNAVQQAQQHAEDAVWAREELESKATQLEQLETSVVMWKEKVKKAKLQDSERILSLNQEMEAWQREFRKVSESVLMLCAGGSCGTSEGTPTEWAETLCQVVKGAQGALICLSVDLGTEGSWAGIQSLKEQGLAALHARASAAKEAAVRLEALEDDVLRLKELETSLSARCEGAEEHARNVEENLKRASTQAERVPQLEQETNELRTRCDLLRKELQRQREAMQPERSQLYETARSEATASSATENVGAVQSALLAAAGCVSERDVVTFVGHRSLQDGSVKLSKAAAEQLRKENTELKRENAHNNTVIAQYIRELEGYKANERVQLSIEYLRNIVHQYLCAAEDLRPKMIPAICTVLEFSSKQKEDVQAANVRCPQFH

SEQ ID NO: 121 - protein, 425 aa, L. tarentolae
  LTAR_150005200.1
MRPNLSVRRMTHQWKRLRVTGTLVLSALVLFAFVVYYQSPSFSPCDSAYANVYDIVIDAGSTGSRVHVFQYERADAGVVLLRERFKRVEPGLSSFVANEGGARESLTGLLHFADQVVPQSYQRCTSVTLKATAGLRLLPERDQQVLLDTANQILNESPFQSRGASIISGTQEGVYGWLTVNYLLDSLDRAVATVATIDMGGASTQVVFETTSQSGEWIPFNYVHQLRTPKRAIALYQHSYLGLGMNEAKKKLMASFAKVNGTSSFPCFPRGYTKHLNDVELRNSGATDFDECGVLFQEHVITKPTCKFDACGARGVPQPLIPSKPHLIYAFSYFYDRLYDFIKEGSPIHVSSYKDVGHQVCQRESLGRTTAPEETACMELAYMYSFLTHGLGLTDDTTLMVPNRIGGMAVSWSLGSSLFFVLKME

SEQ ID NO: 122 - protein, 630 aa, L. tarentolae
  LTAR_170022300.1
MTNPSNSNLQALREALCAPDLDQGHLFEGWPETVDECNERQIDVLTDLYAFSNVYPGGIAQYIRNGRELLARESEEVDFAALEMPPLIFEAPSLHRRTAERTTLENAGTAMLCKTVFVLVAGGLGERLGYSSIKVGLPVETATNTTYLAYYLQWARQVGGRGVPFVIMTSDDTHDRTLQLLSELQLDMVNLHVLKQVQVFCFADSAAHLAMDGTGRLLRKPHGHGDVHSLIYNATVKREVVPGSGDGITTAQPLLDEWLAAGYESIVFMQDTNAGATVTIPISLALSAEHSLDMNFTCIPRVPKEPIGLLCRTKKNSGDTWLVANVEYNVFAEVSRTLNKDGGEEVSDGGGFSPFPGSINTLVLKLPSYVDRLRESHGVVPEFINPKYSDETRRSFKKPARIESLMQDIALLFSEDDHRVGGTVFERFSYQPVKNSLEGAAALVAQGNSAYCAATGEADFYELQRRRLKAIGLPLFYNSEAEVTVVDNAIRVRVFPIIVLDVMCASGGSLSDLARVFSTPEKARIDHRSTLIVEGRVIIESLELHGALIIRGPSDPTAPPYVVRNAVVRNDGWSVHAISSLSPERVSRLSEVDHIRGFVLEKTTMAVMDFKGKCAPEAGSLSGAADPAKL

SEQ ID NO: 123 - protein, 812 aa, L. tarentolae
  LTAR_180005800.1
MRRSPMSPTILALVLLLATVASSVPVVTTEGGLALEAIGYPNDVMRLTVKPGVKWTYQPEGIILPAGVALHPIKGDGDKQWSIPHGDCLLTVSLASVYVRFEFSCHGKSFVEATAFSDAMAAPEVNFTFPAAQAMYGLAEHAADLMLRGGRVYEMYNKDPFHYSVNSTEALYGAIPFIMAYAPQSTCGVLFLNPSETNVSISADSAVPSCQWKPEVGVIDIFFLPGPTPAKVQQQHATLTGATVMPPYFSLGLHQSRWSYLNMKDCLSVDEGFDIHNMPYDVLWLDIDHTDKKKYFTWDPYTFPDPKALSDALASKGRKLVSVRDPHVKRDKEYYVHKEAQNGGHYVRDSSGRDYIGKSYPGNSSWPDFLNTRTRDWYSQLFHDNRYPGGSRDIHTWVRTNEPSVFSGQGGTMAKTVVHTLDNAQTVEHRFVHNAYSFYSVQAVHKGMVEAGGPDAVPERPFILTRSFFAGSQRYAAMWTGENTAAWEHLENSIPELLSLSISNYPFCGCDVGGFFFDPGEELFVRWMQAGVFVPFYRAHAHLETKRREPWTFSTEAQSLVRSALALRYALLPYLYTTFYHAHVDGNTIMRPLFYEFPLQSELRDVQNTYLFGPSILVQPVVKPSVTEVTVPLPKEALWYNYFSGELVVKQHTMPVDKDTIPMFLRGGHIVPMKLRLRRSSFAARLDPFTLFVALDAQGISNGDLYMDDGTTYNYKKGAFVHRIFSFSNQVLRNSAYPDTLGSAGLYNAVNVVERVVIYGYAGRAMKVILSTRVDQTEVATPLEFEQLGNTVIVRKPNVLVAADWIISFENE

SEQ ID NO: 124 - protein, 560 aa, L. tarentolae
  LTAR_180008900.1
MPLTVPTSSMALISLIVLVAQNSLLVVMTRLSRKRVDAAHNYHTSTLVINQEIVKMVMCLILYGLDDVYKQYQHDAASSDCASSTKHNVVASESNALLLREDRANSVEGKVFQAESKEAPPAVDDEPLEVHVTSSPVPLPQTMVAGIVSVESTSHMVDELRADDDTSGMPQVRSTYRSGATLGIMAPFSRQVLRLPFVNSLTGLCNALAHPSTRTTDHGEFSRSVDVPETMRKGNFFMRRGTKTLCALYCSMLCASLYKRDTLKLLVPAFLFNLQNFLIFVGLSNLDAVSFQIWSQTKLLSTAVFSVWLLGRKLSPMQWLSLVALTAGVLGAQLGTPKVSVAMRPTAARHLLDGSTKTPDLRDAQLHAGDDNEPGGNALIGIAACVLSGLSSSYAGVYFEKVVKTTSPTLSLRNIQLSLFGIPIGVASMLFLDVFPNWYASLRCGQRVNWNIFSPPTAATRGLGEAETYCHVQPFYFWQRYDDSFTWALVFIHALGGLLVAIVVKYTDNILKGFATGVAVIVSGMMCFAIDGYQPSLAFVPSAALVIGSSIVFHKFERRR

SEQ ID NO: 125 - protein, 873 aa, L. tarentolae
  LTAR_180015100.1
MFQYEDLMWLISFPLVCAIMMWFSLDLAVLVRVGGGRRRRANARRAIERLIMSSSVSTTTSVVQSPSQVSTPNIDPSSRRRSGSASLENACMGGLGDNSGCEEEHGARHRASSAGGTGTSTTGEIPRHQQHVRQVVIPAALRIATRAVVRRAVVLVGGDFARSPRMQYHAASLARSGLFDEVLLVGLDYGNQLSEDLLTSGEPQPERFIVWEDPATPKRMENAAFDVQARLDSPTPRPGCGCLVSTQYLIAPPSPPEWLQTVFPLIHLHWVVCTVYRVLTLAGLFFFQTMCATATRINEHGQLLVTDLILIQTPPAVPFVLLVKYLVCPLAFLYNSLLYYGVVVPAAWMHPSAMQDVRQQCQLQSLRFTAEAKPPAGGRHGSLAIWRGLTHPSPLRTRCWVFYPSIVVDWHNFGHTILAQNQRPTAAVKMYKLLEMHMCAGHVNVTVSQAMRRALEHAYPWLRCEPAITTAVTVQPQGSASAAASARLKAEEAPLAAVVSPNAVTVLYDVAPSFFRPVQRSRCVREVLERLLLRRGAISSSPPLASASALTKGAGNGAAYALVSKTDLEAMGWGIAGPPAWVYADAAEESVALSALGTSAAAPATMTRVSRRGIMVVGSTSWTEDDDYSMLIQALQRLDHRLRHEVNYRSGSGDSSPSTSRGPADLWVLITGKGNARQRFEDAVRLAKLSSHVVVSTYYAQSYQEYSVLLGAADVGLCLHFSSSGLDLPMKGVDMIGAGLPIMAMQYPSIGELIGSATRVLRTQATRLCNDAVDAPETSRVSGGYTKTVLPTLLECERGWSFCNDADLAFLLSNFIGLPSPSESASDDASSLLRSSPTPLSVMKRRAYEARRRAPTWEENWRRVLLPVLNQVV

SEQ ID NO: 126 - protein, 493 aa, L. tarentolae
  LTAR_180015800.1
MEHSMKTLSTAAQACVKKMRDAKVSEACIRTFIAQHVMVSNGETGCIPDSDIMAVESLDALDSLTVECDNAVLQSTVVLKLNGGLGTGMGLHDAKTLLEVKDGKTFLDFTALQVQYLRKHCSEHLRFMIMNSFNTSASTKSFLKARYPWLYQVFDTEVELMQNQVPKILQDTLEPVSWAEDPGCEWAPPGHGDIYTALYGSGKLQELVKQGYRYMFVSNGDNLGATIDKRVLAYMEEKKIDFLMEVCRRTESDKKGGHLARKTVHVKGKDGLDTEKKVLLLRESAQCPTADMENFQDINKYLFFNTNNLWIRLPVLLETMKEHGGTLPLPVIRNEKTVDPSNSASPTVYQLETAMGAAISMFEGASAIIVPRTRFAPVKTCADLLALRSDAYIVTDDFRLVLDDRCHGHPPIVNLDSAHYKMMSGFEKLVQHGLPSLVECERVTVKGLVQFGAGNVLTGTVNIENAGSASAFVIPDGAKLNNITVSHPQSTDT

SEQ ID NO: 127 - protein, 570 aa, L. tarentolae
  LTAR_220014900.1
MSVKGGCADRRGAKSLPVPPSTPATRSTLSVTPPWSTVVAAKAGACSKVLLLAQMLLCVIGINACFGWWSVKQERVITKPYFIADSAFAASMVAAAAATHDARRAAAVAAAKANAPADKPHVVYLSTVYGISLTQTLAGAVVSATLLAMSKLLRRVMLSYQQRFGRQRGAKPNVSTARDQTHCTGLNRRDVQGMLAMGFSNIFGTSLGYAAMRRVSYPVALTAKMGKMLPVIFVGFVWYRMRYPAKKIASCLLITGGVIAFFLLENRITSTGSSKKSGAASSSSSFVGMALLFLNLLMDGYTNSTQDMLVKRHRWSGVSLMMRTNVVSVVCALSLLFVLECGEQPWIWLASFSHGTVTSAMRRFPVSSGALEAWRERVGGVSVMSAVPFHDLSHFLGFLMHCPEARHDVFLMSLLSAFGQLFIFHTITVFGTLALTAMTLLRKSGSVILSIVIHGHTVHRAQWASLGAVFIGVVLEGYINIQEASLRQGRMTTKRATPHEVAATPNPSPPRRDVPVKSKPASGYASGIRKNANATEGATAKTLVKARALRGITDTTAVPASSPQEVKKRQ

SEQ ID NO: 128 - protein, 562 aa, L. tarentolae
  LTAR_240008400.1
DPLKSHFVCLHRIGSIHRRQAPEGCPTTLVKLCPYVRADSAGASPFSVASPPPSPSSASFQVVLSHPPQGLPRFFTVPAYAEESLKQHFVCRSFYVSTSHSHCCGSIGMVGLPSPLWARRYLLNFNSLALVLLSVQNAGYLVLMCYSQGKGKDSPPAAGHHSQGGEDKGSTVQFKASHFLATTEVMKLFLSLLWCALDEARAMQHDCGSCETSTPPTAALRVQSGRRSSVVTFAETPNSISEASCHRVYSLDDIAEKDTESVDHIVRLQTLVSQKKFCVLFLSRMRHAIGLDHKYKETLLMIVPAIVYAMQGLLLIYALKLLDPTLFQVLYQVRILFMAVMMRVVLDFRLSPIRWGALVTLMFGITLAQMGAQKTRGDTAASKAGDTAQSRVERAVVAHRMACTWSMEGTLAALAGGFLSAFSGVFMEFVVKKRGNHFHLSARNVHLAFFSAVYFFIVFLCEIFQAEGATGVAGSAWKFRSTFFDGFTGLVWFLVMLQAIGGILVALVVRNCDNIVKSFSTAFSIVLSGTASVFLLHTPLSGTFLGGSFLVLTSITMYTVKK

SEQ ID NO: 129 - protein, 553 aa, L. tarentolae
  LTAR_250005000.1
MLAYLCVCVCVSLSPMLSLSLVFHGWHIDTRTMWYLCTARVVWRTSRRTIEIVLFSDASFLTSSHSVINLSLFCGQTLRLSFSGGTEPSPLPAEDAYPVDADAPYPVFVGKKRKGSHTVLASAPAFYVHRRRWLFARICLHTLLFLMGYLGPLIILYRRLREETFTDIARPGEVFISDETFFECVADRLSHNEQQSASIPYVLIPVTMDYQDIKQLFCNITVPMTYIMFINNGEFHPLRSLLNRLAVELKEFVDKNLFIVHHPENIGYAAAVNEGLRHALQFSIEQVPWVFITNADVRFAPDLIPEFVAQAHAKTGNQKEILRMLDEEVAAEARTLRNVTDPRFAYRSSELPVVSASSLPYRIRTMAPEEMKRQFADTYGVFYTDSKAFMATFALSRLAIATVGFFDENFYPAYGEDHDYVWRMEALGYKSYMSMRGKFVHFENANLKADGAARNRGIFRSTAYFMQTMRFQRMNNELFRREYRRTKWFSVDGTLYQTTGRKPLPFNGTIPVDTWVLDPQRLRSIYEIGEGMRCYSSYNYYNTKLLQFSAYVS

SEQ ID NO: 130 - protein, 609 aa, L. tarentolae
  LTAR_280017500.1
SAAAAADGSGKVEAPCIGVDLGTTYSVAGVWQKGEVHIVTNEMGNRITPSVVAFTDAERLVGDGAKNQLPQNPENTIYAIKRLIGRKYADPTVQNDKKLLSYDIVADKTGKPLVQVTVKGQQKQFTPEEVSAMVLQKMKEISETFLGGKVKNAVVTVPAYFNDAQRQATKDSGKIAGLNVVRIINEPTAAAIAYGLNKAGEKNILVFDLGGGTFDVSLLTIDEGFFEVVATNGDTHLGGEDFDNNMMKFFVDGLKRKQNIDISNDQKALARLRKACEAAKRQLSSHPEARVEVDSLVEGHDFSEKITRAKFEELNMALFKNTLVPVQKVLEDAKLKKSDIDEIVLVGGSTRIPKVQQLIKDFFSGKELNKGINPDEAVAYGAAVQAAVLTGEAEVEGKVVLVDVIPLSLGIETVGGVMTKLIERNTQIPTKKSQIFSTYQDNQPGVLIQVFEGERGMTKDNRLLGKFDLSGIPPAPRGVPQIEVTFDVDENSILQVTASDKSSGKREEITITNDKGRLSEEEIERMVREAAEFEDEDRKVRERVEAKNSLESVAYSLRNQVNDKDKLGEKLTEDDKKAIEGAVKEALDFVDENPNADREEFEAARTKLQ

SEQ ID NO: 131 - protein, 609 aa, L. tarentolae; identical to SEQ ID NO: 130
  LTAR_280017600.1

SEQ ID NO: 132 - protein, 606 aa, L. tarentolae
  LTAR_280017700.1
SAAAAADGSGKVEAPCIGVDLGTTYSVAGVWQKGEVHIVTNEMGNRITPSVVAFTDAERLVGDGAKNQLPQNPENTIYAIKRLIGRKYADPTVQNDKKLLSYDIVADKTGKPLVQVTVKGQQKQFTPEEVSAMVLQKMKEISETFLGGKVKNAVVTVPAYFNDAQRQATKDSGKIAGLNVVRIINEPTAAAIAYGLNKAGEKNILVFDLGGGTFDVSLLTIDEGFFEVVATNGDTHLGGEDFDNNMMKFFVDGLKRKQNIDISNDQKALARLRKACEAAKRQLSSHPEARVEVDSLVEGHDFSEKITRAKFEELNMALFKNTLVPVQKVLEDAKLKKSDIDEIVLVGATRIPKVQQLIKDFFSGKELNKGINPDEAVAYGAAVQAAVLTGEAEVEGKVVLVDVIPLSLGIETVGGVMTKLIERNTQITKKSQIFSTYQDNQPGVLIQVFEGERGMTKDNRLLGKFDLSGIPPAPRGVPQIEVTFDVDENSILQVTASDKSSGKREEITITNDKGRLSEEEIERMVREAAEFEDEDRKVRERVEAKNSLESRVLASQPGQRQDKLGEKLTEDDKKAIEGAVKEALDFVDENPNADREEFEAARTKLQ

SEQ ID NO: 133 - protein, 609 aa, L. tarentolae; identical to SEQ ID NO: 130
  LTAR_280017800.1

SEQ ID NO: 134 - protein, 609 aa, L. tarentolae; identical to SEQ ID NO: 130
  LTAR_280017900.1

SEQ ID NO: 135 - protein, 946 aa, L. tarentolae
  LTAR_280028000.1
MRDRRLLLRKDAETAGTELSMPVELAQERYQRIKKRQAKDIQRGALSYLLFILVFLGIPLLIVWYCTPFFVLQHLRCRLKEKYLWSDSTVRAMEDGYTRYFNEPPLYPSKEYNRTMMWGTYEPSRIFAVKSRSLKPVTVGIAWYDSAMEHPLRHTMPYLHNKVNAPRTTQRGIDAEVMQVKWVVNDGLHYAKEVVEDRGNKASFEIELLKSPFADAWHVRIHARVESDSPLVMVVYMSHADTQERIELETPIESNDGDWSPVLKSRMQPEGAAEHTDFTLRVYDDHSPLYDTAPWHVYGLHTDVETAFRRTAVDVVGTTLAERAAAGGRGIGGDVHVGELQQQQLDLRRLPESAFTYIQAKDPSSFRTPPSWASHNVMILRKSYDSSFRLELSLSPADHAQGDAAPEASMPSRIGKLVPRYEALSTCQLTNALRWRSKAISLHSAKIFRPFLSVFNSSKGLYKRMATSTLAELFGSLTFTSGLYLHVGADMDDAWDKQGRAGEMWSDAQLQTSRKRVSALAVVGSRTDEAFGQQSLTGLPLLFLTRWNKEVVKDILASWMLGAQDPETGFVPNRAVFGAETRSFTPQALRYEHPTLASPPTLLLGLQELLREMRRKSARIATANHRKARNTPEYFERERAADETFLRAILPALKRWRNWWHHTQCGGATDELARKCRSRKPLEEWPLRPVEDQPESLLVYRWRGRDGHRLPTSGMEDYPRPVCAGESHREAHVDAFSWIALLSTLISRIETEFLHEAESVSLDWEAHLNAVHWDAAEMRYGDRIGCNSWAYTPYFGYANLYPVMLGLIRRDLSRAARTIALAQRELESDYGLMSVSFSSVRLARESGLRHHNMWMGYVWPSANLLFLYGVKSHYLEALGNTSAAAGGLPEARLRDFYTSLRVSVIETIRGGSRWWEYYSPLDGRGEGSKTHIATRSLLLGLLDDFA

SEQ ID NO: 136 - protein, 739 aa, L. tarentolae
  LTAR_280030200.1
MSSLTLSSFKGQLLLALLLSIGLKVLTFSLSTILTRLLLPYQNGVNFTFSVYNEAVLFIVRETTRNVASRLPIIEPSAEAEDSIKQNSESVAAHDMSPGERGGAPSPPSAPSVQVPASVVKVANVRAVVSIALCSVPLAFVVAAVVEAFGMCLGTASFFPSMMQHALASQQMFRKVPNVGGLDGASTLVGHPFLLLPYLPEMTVVICTLLMTAVEPCVVLAQSLNLFRVVVLAECATLVARLCAIIGIVYACQRNSTGGSTPGDEVGNGLLTIWETRMTLAFGQLAYAVTHVVYYTLVLSGLPVARWLGSSTSMEQVRAAALLAHARGDVGQAEQDAGADEFAGAAKPAQSSALPAPPHPSRWATFAFPFCLYSIVDSVSACRRYASLLNMFLWESLLRVVLAKGESLTLTSVGSETARGYYQLISGLGSLVARLLFRVWENACFVKWSREASLGHRHTSVHLLKLMLRVAFYVSFFFSLLGPPLTKTFLTMVYTSRWATPQVSTALQLYFYSLPLIAWSGLLEAFLRAVASPALLQRLQRWMVGETALYMTACYVTLVAFGKADTQGESVSVLVLLNAFNTLWRCGVSIYLLVSSPGGAAVGAATASSADAQAQDGCGGPAAPTAHSLPLPSLAVHLSDFVSLFPKHILGSILGIFVCSRAMRANSVLAIAAVGLAYTAVVLAWDEEVRQLLVTPVWSRLRPLLQGQHNVSHAGPAEVPPRRARLPKRMAARPATHAN

SEQ ID NO: 137 - protein, 789 aa, L. tarentolae
  LTAR_290012500.1
MTNTRLLNVVLVALLLLGSVTVSAGDGRGTPITFQAEVSKMLDILVNSLYTNHAIFLRELISNGSDALDKIRVLYLTSPKEPLTKDGEAPTMDIRISFDKEKNALILRDGGVGMTKEELATHLGSLGTSGTKNFLEKLQEGVSAAGGDQNNLIGQFGVGFYSVFLVGNRVRVASKSDNSDEQYVWESKGDGQYFLYVDPRGNTLGRGTEITIELKPDSEEFLSAETIKKTIHQYSEFINFPIYVQEEVEVTSTAETPESAEEEGSPDKDTVEEDSNKKGDKQTVVKEKRWTLVNENRPIWTRPIGNVTEEEYHKFYKGFSGDYRDPLYFNHFKVEGEVDFDSILFVPATVDPALFDDTNTAPNTNIKLYVRRVFITDEFRDLLPRYLNFVKGIVDSNDLPLNVSREVLQENRILRVIKKKLVRKTLSMFAEIAAQDEAIANGKQEENPEPSGHTHLKEPTYTKFWEMYGKHLRLGAVMDSNNRNRLSKLYRYKSSRSEDKYISLQTYVDRMKKGQKGIYYLSGDSVERIKKSPVLEDAVNHDVEVIFMTDAIDEYVVSQMTDFSGKKLINLAKEGVQFEESDARQRVVDRKRKEKYDAFFTHLRKLFGYLEVRKVIMTKRMTNEAFIVSSSENQVTARLASIIRGQSMSPSDEQMSAERVLEVNYRHPLVDEMFKRFTVNEDDEVAIDIAWVLYDTANLHAEFPVADVAAYSKRINRLLRSSVDLSADDSLLPPDDAEYTVSNTEAEEEKEQPKVDDEDILSHTQTEDEENPKVHVIPDETGTNDQSDL

SEQ ID NO: 138 - protein, 437 aa, L. tarentolae
  LTAR_300010400.1
MWFLVALLLGCAFLVSLWYNVVCYVPIAMRSPHRGLMKVGVVLGSGGHTSEMLRVITELPFSYWSDTRPFYVASATDLHSASLASELEQRRFERRVIVHTIPRAREVGQSYLTSIITTLRATVACFRLICTERPDVLLTNGPGVCVPVIAAAVCVASCAPWWYARPTIVYMESFTCVSHLSLTGRLLAPWLADVFTVHWRALEKAVAQRRRRGMLVHVGSEEARATNGAAHSLPSLSAEQEAYALVTVGSTKFSSLVQRMVQPDVCTVLHRRFGIKRLYVQHGTAEVIVPPEATFLPPPLTASGADASNPTQRWSCGGLIVEAFSYRPHLDTVIRGAALIITHAGAGTILEGLQAQRPLVVVPNRELMSDHQLELAEALAAGGFLFCVQVAELAERLPLLDVTNLQPHSGMDAAQLKEALRLVLTGHSAGEGRAKTA

SEQ ID NO: 139 - protein, 325 aa, L. tarentolae
  LTAR_300010400.1
MSSVVLFFSLLLNITSSIGVIIVNKRMVFMEAHFEFSTALTIIHFITTFLGCLFFAYGVKAFTPKKLLIREVFPISCAFCGYVVFNNFSLLTNSVSVYQVMKILCTPLIVLVERVRYGKQEKLSTLLSLLPVCLGVGVTFYADTDVNWIGTVWACLAIISNSLYTIWGKTKQVELDAQPMQLLIYEAPLSAVMLLLVVIPLDGGGKLAAYEVTFKTVWALSLSCIFAFGVNFSFFLFVGKTSPLTMNVVGYVKTLLVFLLDFMFVSANMSPKKLIGIFLTLLGLAGYSYSKIDSLPPRIPTSRRTWRRRSPYQRNSDIEVKVISV

SEQ ID NO: 140 - protein, 379 aa, L. tarentolae
  LTAR_310032700.1
IASVRVLCVYVVRAESLFYELRADGWVQSDNSSDQGKVQLRVGALHMDAAKQQGPKLTEDAELSAVSKTPPKVMFNDRKPMLIAFSVKSEQKRTCGGTLKLSSDLDQKDLREESAYWLMLDPDTSGSMSRLQFIFNYNGRNALWKLWKPKDDKATPRYSVEIPPKYTSRLHVDGKYIERVLEGWVILRSRTIPDPEGGALAAWVDDRLPDDPSDTKTDDDDDATITDLEAVKPDDWDDGGGDGVEAPKTPTPSYRDAWPRPVKESEYKGQKAKQIPNPAYKGGRNLCRTPAPLQDVGMDAWPLEGGNIFDDIIVYDILEEVLKVVKHVYGTVAEKERELIEANAKKDMRELERAEAMWTGRKRADYGPDEDDIKDEEVL

SEQ ID NO: 141 - protein, 421 aa, L. tarentolae
  LTAR_320021400.1
MCDLIKLDVGYQNYAWGKDAASSFVAKMKGLTNDKSGKMFAELWVGTHPSCPSKIADGNAQLLEDFLKEPENKKKYFSEAHQATDFRDTVPYLLKVLSIRTALSIQAHPCKKLAEELHAAKPDKYKDPNHKPELICALTTFEALCCFRPLGAIMAYLKCIPELAELVGADAVLGKYMVAPETELPASDSDAEKALLKAMMTNLYAVSEDIVTKALRLHLQRIEEKGAQCAEDELFARVYSQYPDDVGCWMVYFLNYVQMLPGEALFLSDSEPHAYISGDGVEIMACSDNVVRAGLTPKWKDVSTLISMLKYDTTGLASARHEKKSSEDAAHWQVQYYQPPAQFPDFSLYRLQYEEASGNGTTSVTLPTIGLGFCLEGSVKVNGTTLIAGDCFAVPYGKMTCEADGSKALVFVASTNDLSDR

SEQ ID NO: 142 - protein, 309 aa, L. tarentolae
  LTAR_320045300.1
MRAARNWKKADFFRHIPRDLTESTTTGSVISIACVIVMVLLFSGEVISYVFPRTQSDMIIMPDLDEMHSIKVSMDITFPKMPCAILTVDILDVLHNHMLNSMEHINRTRLDASGKPISDGHSTDDFVSVEEGCRLEGYIKVAKVPGNFHISSHGRKHLVVKHFPHGINVEHIIHHLSFGSVDVRTLSNKAALRPLDGKEYRSDTPKVYQYFIDIVPTIYEKSFSTVYTYQFTGTSSSTPVQEKQMGAVVFQHQLSPITVRYSLARVSLTHFLTYVCAIIGGVYTVAGLLSRFVHSSAVQFQRRILGKVD

SEQ ID NO: 143 - protein, 414 aa, L. tarentolae
  LTAR_330034700.1
MRVLVCGGAGYIGTHFVRELLRHSPHDVVIADNLEATHGSDVHMDTEKSYATRNPGADLEKVKASGYRFAKLEVGDVRDVNFLERVFTTHSPIDAVVHMCAHIVVPESVRDPLKYYDNNVVGMLRILQTMLKYKCDKLILSSTAALFGNPYARMKADSTNESDPMKPIPSNAKCLPESPYGTTKLVDEYMLKDCAAAYGIKSVCLRYFNACGADAEGDIGETHEPESHLIPLILRVPLADKINAYNAVHHPDRRKVNDYVSIFGTDYPTPDGTCIRDYVHVKDLSSAHVRALEYLDKLTLDDKDMFFSTFNLGTSRGYSVREVIEAARRVTGHPIPEREEKRRDGDPPVLVASGEEAAAALGWTLEYDSIDKIIESAWKFHNKHPVGYETPDVAPSAQARVLDSKGMPIQQGGL

SEQ ID NO: 144 - protein, 550 aa, L. tarentolae
  LTAR_340026600.1
MALLLHVFFYAFVAACVLRYFIMRVRIRSTEMYVQRRKKAVEAYEQLHKLSSRQATLEREDDDHVAETDAPTDLLSKEPLFVVFLHPELGIGGAERLIVDAAVGLMKCQSIRLVEVIIVTNHHDCNRAFKETTDGTLRIVVQGSMLPATIFGRGKALCSMMRMCFAAIATCWSFPNADCFIIDQVAVAMPVLNFFASRTPLLFYNHFPDKLCDANRNFDGTFKKRGSPLYPFQKIYRVFFDKVEAFAMNYATSIVCNSKYSRQVTIDTFPKLADKIHETTDIFYPPVEMKVHEVTEGALSASEALRELKEIVSGAVTFVSINRYERVKNIQLAIEAFALLLSMDEFKSTKDKKPLMLIIAGGYDPRSEENVRYADELMSLATRTLHIPAFQVRFLKNINDDEKTVLLSEMRALVYTPSREHFGIAPVEAMAYSKPVVAIASGGPLESVGSVELEDSSKCGGLLSSPKPMEFAQKMACFARDPVYAAKVGAQGRARVLERFSKESFSTQLVTRLVHLRSRADERLFAEGIESVQPEAASKVDKSPQNAQND

SEQ ID NO: 145 - protein, 341 aa, L. tarentolae
  LTAR_340034000.1
MNRTRSVIEAVLSVITYSFCSVSMILVNKLIMNTFDMNFPLGILVLQSGGAVVIVTLAKAARFIEYPAFSLEVAKQWLPLTLLFVAMLFTSMKSLGTMSVAAQTILKNLAVVLIALGDKFLYGKAQTPMVYFSFALIILGSFLGAIGDKWVTAWGLFWTFLNIVATVSYTLYMKAVLGSVSNSIGRYGPVFYNNLLSLPFFLIMGVGEVTPFLAAIGETSTLGKLVLTFSVLLSSVMTFSVFWCMSITSPTTMSVIGSLNKIPLTFLGMLIFHQFPTSTGYLGILIALSAGFLYTHLNIRANRAKASADPENQMSPSGKSTAEPIVVVREDESSGDTFKSE

SEQ ID NO: 146 - protein, 851 aa, L. tarentolae
  LTAR_350014800.1
MPPKNEHKAGGDGNHGPASTPPAATSANETTTNVNAAVDSSQSPSDETYLFNCRAAPYSKLSYAFKGIMAALIIYAIGLAYQIRMISVQMYGYLIHEFDPWFNYRAAEYMSTHGWSAFFSWFDYMSWYPLGRPVGSSTYPGLQFTSVAIHRALAAAGIPMSLNDVCVLIPAWFGAIATAILALMAFEVTGSICVTAWAALSFSIIPAHLMRSMAGEFDNECIAVAAMLLTFYCWMRSLRTRSSWPIGVLTGVAYGYMVAVWGGYIFVLNMVAMHAGVSSMVDWAHNTYNPSLLRAYTLFYVVGTAIATRVPPVGMSPFKSLEQLGALLVLVFLCVLHVCEVLRARAGVEVRSRANFKIRVRVFSMMAGVAALVVAVLAPTGYFGPLSARVRALFVKHTRTGNPLVDSVAEHSPADALAYLHYLHIVHIMWILSFPVQLILPSRNQYAALFVFLYGFTAYYFSTRMVRLLLMAGPAACLGASEMGGTLMEWCFQQLFWDNDMRTADMVAAGDMPSHQRARSHRHAGAAQKQRKTQGIQNSASGPSRSSEQRPYRTLIPVDFRRDAKMNSWSTGKGNAILILSLAIGVLLPVTFIFYFSCLRSATSFAGPNIVFQAQLRSGEKLMVKDYLEAYEWLRDSTPQNARILAWWDYGYQITGIANRTSLADGNTWNHEHIATIGKMLTSPVAKAHSLVRHMADYVLIWAGQNGDLMKSPHMARIGNSVYHDICPNDPRCQQFGFYRNDFNRPTPMMRASLLYNLHEVGKAKGVEVDPSLFKEVYSSTYGLVRIFKVMNVSKESKKWVADPANRVCHPPGSWLCPGQYPPAKEIQDMLAHRVPFDQIGENKKRNEKYH

SEQ ID NO: 147 - protein, 822 aa, L. tarentolae
  LTAR_350014900.1
MRSKPTAAAQGATKASQRNGVAYPIPATVPAVSTETSSVNKGFARAFSAVRTLLLLFSFLYCLKAAYEIRMISVQMYGYLIHEFDPWFNYRAAEYMSTHGWSAFFSWFDYMSWYPLGRPVGSSTYPGLQFTSVAIHRALAAAGIPMSLNDVCVLIPAWFGAIATAILALMAYEMSGSGITAAIAAFIFMILPAHLMRSMAGEFDNECIAVAAMLLTFYCWMRSLRTRSSWPIGVLTGVAYGYMVAVWGGYIFVLNMVAMHAGVSSMVDWAHNTYNPSLLRAYTLFYVVGTAIATRVPPVGMSPFKSLEQLGALLVLVFLCVLHVCEVLRARAGVEVRSRANFKIRVRVFSMMAGVAALVVAVLAPTGYFGPLSARVRALFVKHTRTGNPLVDSVAEHSKTQPEAYIFFLDFTYSLWMLGTVLQAFGTAMWSRKEAQLFMGLYSLATYYFSDRMARLMVLAGPAAAAGTAGILGIVYEWCWAQLTGWASPSLSAAGSERETGFKDNAGSAERLASTGTRKRGVRAHAIAAVSSIKSSVDLLPQALRVGLAVAIIAATVGAPYVSEFQARCIQSAYSFAGPRIVFQAQLRSGEKLMVKDYLEAYEWLRDSTPQNARILAWWDYGYQITGIANRTSLADGNTWNHEHIATIGKMLTSPVAKAHSLVRHMADYVLIWAGQNGDLMKSPHMTRIGNSVYHDICPNDPRCQQFGFYRNDFNRPTPMMRASLLYNLHEVGKAKGVEVDPSLFKEVYSSTYGLVRIFKVMNVSKESKKWVADPANRVCHPPGSWLCPGQYPPAKEIQDMLAHRVPFDQIGENKKRNEKYH

SEQ ID NO: 148 - protein, 761 aa, L. tarentolae
  LTAR_350015000.1
LLLLFSFLYCLKAAYEIRMISVQMYGYLIHEFDPWFNYRAAEYMSTHGWSAFFSWFDYMSWYPLGRPVGSSTYPGLQFTSVAIHRALAAAGIPMSLNDVCVLIPAWFGAIATAILALMAYEMSGSGITAAIAAFIFMILPAHLMRSMAGEFDNECIAVAAMLLTFYCWMRSLRTRSSWPIGVLTGVAYGYMVAVWGGYIFVLNMVAMHAGVSSMVDWAHNTYNPSLLRAYTLFYVVGTAIATRVPPVGMSPFKSLEQLGALLVLVFLCVLHVCEVLRARAGVEVRSRANFKIRVRVFSMMAGVAALVVAVLAPTGYFGPLSARVRALFVKHTRTGNPLVDSVAEHSKTQPEAYIFFLDFTYSLWMLGTVLQAFGTAMWSRKEAQLFMGLYSLATYYFSDRMARLMVLAGPAAAAGTAGILGIVYEWCWAQLTGWASPSLSAAGSERETGFKDNAGSAERLASTGTRKRGVRAHAIAAVSSIKSSVDLLPQALRVGLAVAIIAATVGAPYVSEFQARCIQSAYSFAGPRIVFQAQLRSGEKLMVKDYLEAYEWLRDSTPQNARILAWWDYGYQITGIANRTSLADGNTWNHEHIATIGKMLTSPVAKAHSLVRHMADYVLIWAGQNEDLMKSPHMARIGNSVYHDICPNDPRCQQFGFYRNDFNRPTPMMRASLLYNLHEVGKAKGVEVDPSLFKEVYSSTYGLVRIFKVMNVSKESKKWVADPANRVCHPPGSWLCPGQYPPAKEIQDMLAHRVPFSSMRK

SEQ ID NO: 149 - protein, 554 aa, L. tarentolae
  LTAR_350033100.1
MQAGSILVLCSVALTSEHGESRLLMPLIFLSESCLDHAMNLGHSPILFYASTLLSYLSLIAAKAERRGKSPRDRNVVAETVLYAVVGLAVVFFIVQDRVISLGGIAYVLSGYIFFLKMCPVIGVNEAILIGSLVGFYFCDVCVNNNLSSDGGRESVLSLNAPGYRTSYPHIASRGVILWAIYIFIVVSVLSRWCLIPTNKNSKSSQRRVSRKRITVIFWVSNAVVGVIMVLVISYQFRENVLRWVFAYFVSSRFRMWTIVCWFTLLPFAVFLVDVLSVQFRQTVRRKLFHFIGVVAFTPATMIDPPFMAFAFSTAISLCVLVEVARYYNVYGSEYISRFMARHIDDRERIDGVVRTHIYLLVGFGISLMMRCRQLSIDGPPVPAIIELSINVIPGIVSLGIVDACAAITGSSFFLSSRRTLGRYLKNTLFTERANASITHKTTTGTLGGLLCGLVFWALILVIAEVPITGPALYSFTMIATCTLTECFMDGVDNLQLPLVVLGAVNNLFALLLPFEELWANPAITRPNPTTARSMANALTSPWKNFPSPIKDSW

SEQ ID NO: 150 - protein, 262 aa, L. tarentolae
  LTAR_360007100.1
MQYSIIVPAYKECGNLEPLIRRVFAAVTTQGLPTKAVEMLIVDDNSRDGSKEVVERLQKEGFNVRMDVRTTERGLSSAVIHGLRNTSGAYKVVMDADLQHPPECVPALFKALSCDGVEFVCGTRYGSGIEIDKNWPAHRRLISWGARLLARPLTTLSDPMSGFFGIRDSVFRRHAGEVNSIGYKIALELFVKCRVQCFKEVGFNFATRTYGESKLTGKVILHYLEHLYALYLFKVGPIFYVLLVAAVICAMYLLTFLYHLLL

SEQ ID NO: 151 - protein, 783 aa, L. tarentolae
  LTAR_360019200.1
MADTAGSPNLKVKLNKLIVEEPYNDDNSVVSLNPKRMEELNIFRGDTVLVKGKKHRSTVCIAMEDEECPPEKIKMNKVARRNIRIHLGDTIRIFPCKDVPYGNRVHLLPIDDTVENLTGDLFENFLKPYFLESYRPVKKGDSFVCRGAMRSVEFKVVEVDPGDYCIVSPDTIIHSEGDPIHREDEEALDGVGYDDIGGCRKQLNQIREMVELPIRHPELFKNIGIKPPRGILLYGPPGSGKTLIARAVANETGAFFFLINGPEIMSKMAGESESNLRKAFEEAEKNAPAIIFIDEIDSIAPKREKAQGEVEKRIVSQLLTLMDGMKSRSQVIVMAATNRPNTIDPALRRFGRFDRELDIGVPDETGRLEIIRIHTKNMKLADDIDLEKVAKDSHGFVGADLAQLCTEAAMQCIREKLSIIDWEDDTIDVEVMNAMCVTQEHFREAMAKTNPSALRETQVETPNIVWEDVGGLLDVKRELQELVQYPVEYPWKFEKYGMSPPKGVLFYGPPGCGKTLLAKAIATECQANFISIKGPELLTMWFGESEANVRDVFDKARAAAPCVLFFDELDSVAKSRGAHGDGGASDRVINQILTEMDGMNVKKNVFIIGATNRPDVLDPAIMRPGRLDQLIYIPLPDKASRVAIIKASFRKSPLAADVDVDQIAAATHGFSGADLSGICQRACKMAIRESINKEIQLEELKKSGQLDEDADIDPVPEITRAHVEEAMRGARRSVSDADIRRYDMFKTSLQQSRAFGASNPPLPEAGAPAGGSPPQADDDDLYS

SEQ ID NO: 152 - protein, 247 aa, L. tarentolae
  LTAR_360025600.1
MASSAILLFDVDGTLTPPRNPETEDMKATLSKARAAGFKLGVVGGSDFAKQKEQLGESILQDFDYVFSENGLLAYRDGKEFHRNSLLKALGNDKVVAFVKKSLHLIADLDIPVQRGTFVEFRNGMFNVSPIGRNCSQQERDEFEEFDKKHHIRENLINDLKKAFPDYPLAYSIGGQISFDVFPKGWDKTYCLQFVENDFQKIYFFGDKTSVGGNDYEIYTDSRTIGHSVKTYKDTIAIVERLIEESR

SEQ ID NO: 153 - protein, 446 aa, L. tarentolae
  LTAR_360026500.1
MKLVSVALAAEAVVILAVILTMPYTEINWKAYMEGVEGFLAGDVDYRNLKNGTGPLVYPGGFVWVYSVLYYLTKKGEAVELAQWLHAGVYLVTLTMVLRLYTSSGLTWKTIIPLFVSKRIRSLYVLQLSSDCWAMLFLFAAVSFIAGRPSRAVTRSRQWFIGCLCYSFAVSIKMDILLFAPGMLYVMLRTLPFWRVVWNLFVCAALQVAVSLPFLVYDYRAYLAKSVKLDCGLIEQWPVNYRFLDADLVRRPEFGQALFAMTVATWILLWRTRWAARTYLTDSEAQVLHPAIEETRRQSTLSRGRAHGDEAVDDEAQEQAVYASTLLTFFEANLVGVIFARSIHYQFYTRFFYTVPLVLAYTKFPRVLRLMSFALIRQGFESFPPTPNTSMMLQGGFALALFALLFLGRDAPEAAKREAKDTARDNAPNLPHAQVTGNAAGKKKIQ

SEQ ID NO: 154 - protein, 466 aa, L. tarentolae
  LTAR_360026500.1
MTLGLVETSCNAAFSVAVHAPVLGLILIGSIVAYVGTMRYIPHVARTLLERNIFGIDINKSTEEQRRKFAAKRRAGQTEEKEFQRQAIPESLGILVGAVYLSVVMVLTVGLRFLSAAHDGVENAYASLPGPLMTITLMLLLGFVDDVLDVKWRHKIIFTMLGSLPLIMTYDGSLSVLMPCVFRRFALSTINGTNKLLLSLSLVQDEPAATFRVTAPSTWFSYIASHHSYIKVSDSGAALVYLGPLYLVYLSMLCIFCTNSINILAGVNGVEVGQSIVIAVASIVYNLFQMRLERQAGRDWSSAGALAADVRDMTSDHQLRALLLLGPFIGVSLALWRYNRYPARVFVGDSYTYFAGTVLAVSSITGVYSKTLLLFFAPQVFNFIISLPQLFGIVPCPRHRVPTWNPQTKLLSNSHNYTLLNVILYLFGDMHEEKLTWSIIKCQVIACVLGFFIRYVLSFFLYDEVL

SEQ ID NO: 155 - protein, 477 aa, L. tarentolae
  LTAR_360087300.1
MKRLILAFVLCALLFCVASAEVQVATKDNFDKVVSGDLTLVKFYAPWCGHCKTLAPEFEKAADALAGVATLAEVDCTKEEDLSSKYEIKGFPTLYIFRNGEKVKDYDGPRTAAGIVSYMKAQSGPSMKTIAKAEELEELKKEAFPVCVVKTASGDSKLASMMTKLAGSLRTQMNFALVTDASISADDAMESVTVYRQGKEREAYSGITPMTEESVEKFLGIAVLNFFGELNQQTFQLYMNANKEKPLGWLFVDKNTDPKLKESLVAVAEKYRSKVLLTHIDGEQYRPVSRQLGFPEDVKFPAFVMDLERRHHVMDTDIPVTPESIAEFVEKYLKGETKESMMSEAVPEKETVNGLTTVVGHTIEKYTDGTQNVMLLFYAPWCGHCKKLHPEYEKVAKNLESENVIIAQLDATTNDFDRKKFEVSGFPTMYFIPAGESPMVYDGGRTAEDIEAFLKPYLRASAASSDKPSGNSDDGDL

SEQ ID NO: 156 - protein, 21 aa, Artificial Sequence
  deglycosylated peptide [77-97]
GQALLVNSSQPWEPLQLHVDK

SEQ ID NO: 157 - protein, 7 aa, Artificial Sequence
  putative secretion signal peptide from the invertase
  misc_feature (7)..(7): Xaa can be any naturally occurring amino acid
DGVPYEX

---

The invention claimed is:

1. A *Leishmania* host cell comprising:

a. a recombinant nucleic acid encoding a target protein; and b. a recombinant nucleic acid encoding a heterologous glycosyltransferase, wherein the heterologous glycosyltransferase is an N-acetyl glucosamine transferase that is not from *Leishmania* and/or galactosyltransferase that is not from *Leishmania*; wherein the heterologous glycosyltransferase comprises a signal and/or retention sequence, wherein the signal sequence is capable of targeting the heterologous glycosyltransferase to the secretory pathway of the *Leishmania* host cell, and wherein the retention sequence is capable of retaining the heterologous glycosyltransferase in the Golgi apparatus.

2. The *Leishmania* host cell of claim 1 further comprising a recombinant nucleic acid encoding a heterologous sialyltransferase that is not from *Leishmania*, wherein the heterologous sialyltransferase comprises a signal and/or retention sequence, wherein the signal sequence is capable of targeting the heterologous sialyltransferase to the secretory pathway of the *Leishmania* host cell, and wherein the retention sequence is capable of retaining the heterologous sialyltransferase in the Golgi apparatus.

3. The host cell of claim 2, wherein the host cell comprises two or more N-acetyl glucosamine transferases; and/or two or more heterologous galactosyltransferases; and/or two or more heterologous sialyltransferases.

4. The host cell of claim 2, wherein the host cell comprising a heterologous sialyltransferase further comprises heterologous CMP-Sia biosynthetic pathway proteins capable of generating CMP-NeuAc.

5. The host cell of claim 1, wherein one or more endogenous enzymes from the N-glycan biosynthesis pathway have been deleted, mutated, and/or functionally inactivated.

6. The host cell of claim 1, wherein the *Leishmania* cell is a *Leishmania tarentolae* cell.

7. The host cell of claim 2, wherein the amino acid sequence of the N-acetyl glucosamine transferase, galactosyltransferase, and/or sialyltransferase is derived from an N-acetyl glucosamine transferase, a galactosyltransferase, or a sialyltransferase selected from the group consisting of MGAT, MGAT2, B4GALT1, ST6GAL1, ST3GAL3, ST3GAL4, CstI, CstII, PmST1, PdST6, PdST6_b, P1ST6_a, P1ST6_b, or PspST6, or any functional homologue, isoform or variant thereof.

8. The host cell of claim 2, wherein a *Leishmania* signal and/or retention sequence is added to the N-acetyl glucosamine transferase, galactosyltransferase, and/or sialyltransferase, wherein the signal sequence is capable of targeting the N-acetyl glucosamine transferase, galactosyltransferase, and/or sialyltransferase to the endoplasmic reticulum of the *Leishmania* host cell, and wherein the retention sequence is capable of retaining the N-acetyl glucosamine transferase, galactosyltransferase, and/or sialyltransferase in the Golgi apparatus.

9. The host cell of claim 4, wherein the CMP-Sia biosynthetic pathway proteins capable of generating CMP-NeuAc are at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical to CMP-Sia biosynthetic pathway proteins selected from the group consisting of GNE, GNE/MNK, GNE/MNK mutated with either a R263L or R263Q, NANS, NANP, CST, neuA, neuC, neuB, GNPE, or CgNal, or any functional homologue, isoform or variant thereof.

10. The host cell of claim 1, wherein the N-acetyl glucosamine transferase is a GnT-I.

11. The host cell of claim 1, wherein the N-acetyl glucosamine transferase is a GnT-II.

12. The host cell of claim 1, wherein the N-acetyl glucosamine transferases are GnT-I and GnT-II.

13. The host cell of claim 1, wherein the Galactosyltransferase is B4GALT1.

14. The host cell of claim 1, wherein the N-acetyl glucosamine transferases are GnT-I and GnT-II, and the Galactosyltransferase is B4GALT1.

15. The host cell of claim 2, wherein the sialyltransferase is a 2,6-SiaT or a 2,3-SiaT.

16. The host cell of claim 2, wherein the N-acetyl glucosamine transferases are GnT-I and GnT-II, the Galactosyltransferase is B4GALT1, and the sialyltransferase is a 2,6-SiaT or a 2,3-SiaT.

17. The host cell of claim 2, wherein the N-acetyl glucosamine transferases are GnT-I and GnT-II, the Galactosyltransferase is B4GALT1, the sialyltransferase is a 2,6-SiaT or a 2,3-SiaT, and wherein the host cell further comprises heterologous CMP-Sia biosynthetic pathway proteins capable of generating CMP-NeuAc.

18. The host cell of claim 8, wherein the retention sequence is capable of retaining the N-acetyl glucosamine transferase and/or galactosyltransferase in the cis Golgi compartment of the host cell.

19. The host cell of claim 8, wherein the retention sequence is capable of retaining the N-acetyl glucosamine transferase and/or galactosyltransferase in the medial Golgi compartment of the host cell.

20. The host cell of claim 8, wherein the retention sequence is capable of retaining the galactosyltransferase in the trans Golgi compartment of the host cell.

21. The host cell of claim 8, wherein the retention sequence is capable of retaining the sialyltransferase in the trans Golgi compartment of the host cell.

22. The host cell of claim 8, wherein the retention sequence is capable of retaining the sialyltransferase and galactosyltransferase in the trans Golgi compartment of the host cell.

23. The host cell of claim 8, wherein the signal sequence and/or retention sequence is a signal sequence or retention sequence derived from *Leishmania tarentolae.*

24. The host cell of claim 23, wherein the signal sequence is processed and removed.

25. The host cell of claim 8, wherein the retention sequence is a cytoplasmic-transmembrane-stem (CTS) sequence derived from a *Leishmania tarentolae* protein.

26. The host cell of claim 25, wherein the CTS sequence is derived from *Leishmania tarentolae* MAN1, NTPDase 1, or NTPDase 2.

27. The host cell of claim 25, wherein the CTS sequence comprises the sequence of SEQ ID NO: 24, SEQ ID NO: 25, or SEQ ID NO: 26 or functionally active fragments thereof.

28. The host cell of claim 25, wherein the CTS sequence comprises a sequence that is at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical to the sequence of SEQ ID NO: 24 or a functionally active fragment thereof; a sequence that is at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical to the sequence of SEQ ID NO: 25 or a functionally active fragment thereof; or a sequence that is at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical to the sequence of SEQ ID NO: 26 or a functionally active fragment thereof.

29. The host cell of claim 25, wherein the CTS is derived from *Leishmania tarentolae* MAN1.

30. The host cell of claim 25, wherein the CTS sequence comprises the sequence of SEQ ID NO: 24 or functionally active fragments thereof.

31. The host cell of claim 20, wherein the retention sequence comprises a GRIP sequence derived from *Leishmania* or functionally active fragments thereof.

32. The host cell of claim 31, wherein the GRIP sequence comprises the sequence of SEQ ID NO: 27, or a functionally active fragments thereof.

33. The host cell of claim 31, wherein the GRIP sequence comprises a sequence that is at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical to the sequence of SEQ ID NO: 27 or a functionally active fragment thereof.

34. The host cell of claim 20, wherein the retention sequence comprises a CTS sequence derived from a *Leishmania* protein, or a functionally active fragment thereof, and a GRIP sequence derived from *Leishmania* or a functionally active fragment thereof.

35. The host cell of claim 34, wherein the CTS sequence is derived from *Leishmania tarentolae* MAN1, NTPDase 1, or NTPDase 2.

36. The host cell of claim 34, wherein the CTS sequence comprises the sequence of SEQ ID NO: 24, SEQ ID NO: 25, or SEQ ID NO: 26 and the GRIP sequence comprises the sequence of SEQ ID NO: 27, or functionally active fragments thereof.

37. The host cell of claim 34, wherein the CTS sequence is derived from *Leishmania tarentolae* MAN1.

38. The host cell of claim 34, wherein the CTS sequence comprises the sequence of SEQ ID NO: 24 and the GRIP sequence comprises the sequence of SEQ ID NO: 27 or functionally active fragments thereof.

39. The host cell of claim 1, wherein the target protein is heterologous to the *Leishmania* host cell.

40. The host cell of claim 39, wherein the target protein has been engineered to comprise a signal sequence from *Leishmania*.

41. The host cell of claim 40, wherein the signal sequence from *Leishmania* is a signal sequence from *Leishmania tarentolae*.

42. The host cell of claim 40, wherein the signal sequence comprises the sequence of SEQ ID NO: 28, or SEQ ID NO: 29 or functionally active fragments thereof.

43. The host cell of claim 40, wherein the signal sequence comprises the sequence of SEQ ID NO: 28 or a functionally active fragment thereof.

44. The host cell of claim 40, wherein the signal sequence comprises a sequence that is at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical to the sequence of SEQ ID NO: 28 or a functionally active fragment thereof.

45. The host cell of claim 41, wherein the signal sequence is processed and removed from the target protein.

46. The host cell of claim 39, wherein the target protein comprises the amino acid sequence of human Interferon-α (INF-α), Interferon-β (INF-β), Interferon-γ (INF-γ), Interleukin-2 (IL2), Chimeric diphteria toxin-IL-2 (Denileukin diftitox), Interleukin-1 (IL1), IL1B, IL3, IL4, IL11, IL21, IL22, IL1 receptor antagonist (anakinra), Tumor necrosis factor alpha (TNF-α), Insulin, Pramlintide, Growth hormone (GH), Insulin-like growth factor (IGF1), Human parathyroid hormone, Calcitonin, Glucagon-like peptide-1 agonist (GLP-1), Glucagon, Growth hormone-releasing hormone (GHRH), Secretin, Thyroid stimulating hormone (TSH), Human bone morphogenic protein 2 (hBMP2), Human bone morphogenic protein 7 (hBMP7), Gonadotropin releasing hormone (GnRH), Keratinocyte growth factor (KGF), Platelet-derived growth factor (PDGF), Fibroblast growth factor 7 (FGF7), Fibroblast growth factor 20 (FGF20), Fibroblast growth factor 21 (FGF21), Epidermal growth factor (EGF), Vascular endothelial growth factor (VEGF), Neurotrophin-3, Human follicle-stimulating hormone (FSH), Human chorionic gonadotropin (HCG), Lutropin-a, Erythropoietin, Granulocyte colony-stimulating factor (G-CSF), Granulocyte-macrophage colony-stimulating factor (GM-CSF), the extracellular domain of CTLA4 (e.g., an FC-fusion), or the extracellular domain of TNF receptor (e.g., an FC-fusion).

47. The host cell of claim 1, wherein the host cell a. comprises an Stt3 oligosaccharyltransferase (OST), and b. does not have endogenous N-glycan elongation.

48. The host cell of claim 1, wherein the host cell comprises a CMP-Neu5Ac pathway with prokaryotic or eukaryotic enzymes as depicted in FIG. 53.

49. A method for making a glycosylated target protein, wherein the method comprises culturing a host cell of claim 1, and purifying the target protein from the culture.

* * * * *